United States Patent 10,233,495 (METHODS AND COMPOSITIONS FOR SCREENING AND TREATING DEVELOPMENTAL DISORDERS) - sequence listing, part 146

SEQ ID NO: 754 - DNA, 566718 bp, Homo sapiens
aaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaata

SEQ ID NO: 755 - DNA, 6260 bp, Homo sapiens
ccctgaaggacctatatcttaaaagcagaaaaacatctcaacccaagatttaaggattcaaaaaaaaaaaaaccacttaatagttaatttgtttttcttttagagacaggttctcactctgtcacccaggcttgagtgcagtggcatgatctactactgcactgccacctcaactcctagagtcaagcaatcctccaacctcagcctcctgaggagacaagacaacaggtgtgtgccaccacatctggcttttctttttttttttgtagagacaaggtcttgctatgcccaggttggtctcaaactccaggcctcaattgatcttactgccttggcctcctaaagcactaggattacaggtgtttaattgtgatgttctatgccaccatcaaactgaaggcacacccatccacttccactattatgactttctatccaatgtccaatcaccttccttccaccagctcacagtaactcacaagctacaacctttcagaaacttcaggtctttttcaaggtaaaatgctatattcattggcatatatttcttaaccatttaacacgtttaaaacattaggttcttatcttatttttatgttacacaaagtttttgagagttgtgccactaaatccctttttccatgagacctggggttttcactgcacaattttgcacatcaaggtgatttttaggaatgcacatgtcacattacggcagaagtaactgaatcatgagcctgacctgttattgagcgtcagtaggtccgattttaccttggatgcagcttcattgctcttcattttttctctcagagttttccaccacttgctctctggaggatactgccatggtgttttatcaagttcctctaaaagcttaaaaaaaaaaaaacacacacacacaaacacataaactttttctttgccttttttttcttttttttttttttttttttttttttttgagacgaagtctcgttctgtcacccaggctggagtgcagtggcgcaatctcagctcactgcaacctctgtctcccaggttcaagcaattcttctgcctcaacctcctgagtagctgggagtacaggtgcctgccaccatgctcagctaatttttgtatttttagtagagacgaagtttcaccatgttggccaggctggtctcgaactcctgacctcaggtgatctacctgtctcggcctcccaaagtgctgggattatagggatgagccaccatgcccagtctgctttttaaaaataaatttaaatcatattaacacggaagtatcttcttaaagaagactatacggccatactacccttcacattactcagactctttttttcttccagttagtaaacacctgatagaatcaatgggaaacatggaaggcttttgtttggtcagtgtgggtgtctgccagatgctaacacctgatagaaaatcaatgggtaacatggaaggcttttgtttggtcagtgtgggtttctgccagatgctgggatgcccataggacagactggagtgctacctcctccacacctcaagcaagggctctgaaaccctcctcggtctttgacactggaaggaaaaccactccttccacagaactcttgcaggaaaaccaacaaataaccacggactcctatggtacagaccaaatgctccagagtgatttaatatgtgattcaagattatatcctatattgtgtaatcatgacaacaataccaaattgtatcatccaaaatcaagtgataaatgtgactatattttatctcctgtcacagtgaaatgtacaaactatgtacaaataataacaacctgtggaaaagtcactgattagtttgaagagtaaaaagctcttttttacctaaagaaatacttttagatttttccagtgctaagccattcttgccacttcttggcagtaagttcagttcctttggaaggtatactttttcagatagctggatgctatttaataaattagtaaatttagtatattactgtttgcctactgaaagatgttacattttcaatcatcttccaaaaatgcttaacttacataaaaatgagctatgtaccagaagttggacttaacaagttccaaagttgtatttaagaatagttttcaatcatacattttgtttaaaacagatatgaatagtagacccgttaccaagtgaatcaagattaaaacattttcaagaattgactattccctaataagcactccacataaactaaaacaaaagttctcacctgcttagtgacagcatgtatgtttcctagcaaagtaacagcgggctttacattattccccaattcttctgcacagatatcaacctaaaaaagagacaaggctaaagaacaacccatgtttattctgaaaaatatgtaagaaggcaattacgattgaataaatgaactgtgtatatagaacacatgataaagaagatttgatattcagaagttccttaataaaaaaagtaaaagtccatagaactatattagtatcatagctagtatagagagcctcattatcttccctcatttaaaaatctactctatggaattttggtattgcttcattatacccatagggaatgcatttgacctgatcaattatagttttgcatctaatcagtaagttctattgaattacatttggaattcctatctagagtgtgggttctcaaatataagcatatatcagagtcacctggtatattctgggcttgataaaccataaactgtaggagtctacctcagagttttttattttaataggtctggcgtagggtccagaaatgtgcatttctaacaggtttcgcaggtggtgctgatgcgcctggcccagggaaccacatttagagaacaattccaagaacatggcacgattacttctccatttactcagaagttccatgtctggatggccatggacaaatgatggcttctgcaaggaggaatactttagccaccccaaaggggatgtatctcattctataatcaagagggcaatcaagaggtattggcatcttccaggtaactctgtcttgtttgtctgcagttttagttctcaactggctcagctgggaaaggagcaattagaagttgactccttaagaagtaaaaggtagactgggaaaagggcaactgtagctggctcatcaaacatcaagcaacccaagcacagtggctcaagtctgtaatctggcattttgggaggctgaggtaggagaattgcttgaggccaggagaattgctgagaccagcctgggcaacatggcgagactttgtctttacaaaaaaattaaaattagccaggcattgttgtacgcgtctatagtcccagcatgtcaggaagctgaggcaggaggatcacttaagctcgagaggttgagactgaagtgagccattatcgtgccactgcactcctgcctgggtgacagagccaagatgctgtctcaaaaacaaccaagcaaaaacatcaagtaaaatggggcgaatccgtgtagggcaaaaaggtttgcacaccactatgcaggtagtactttccacaccagtaaagaaaatggcttataaggtgggtcataatgatacaagaatcatcaaagacaggtcagaatacattccggatgctgtttaatgacttgtaaaacagtgtcatttagaaattcccattggaagggtgaaagttttggcatctgaaagaaaacctcactccctaacaaggccaaatgttttgttctagtctaccatcctacttaagtctcttttctctacctttaaatatacttgaattgtgaataaaagacaaattatgctttctaaactatttgaaacttgattttgaaaggttttctggctagaagtggcacactatatttcataggctagaaaaggaagcttattttggtacctataattatgttagacaatttgtaaaattctacttgtgtaaaaagagaacagtttttttaatagtaatcaagaagataacagagctgattacggctgatagggagaataatgaacatagacatttctgattttaagttcctcctctctaagtacctggataaacttcacatctggctgatatcttggaggcagtccaaaatgtaaaatccaatttagtctggcaccaaataacacaattacatcagcaaattgcaaagccctattaaaaaaattgatatgaaagtataactacatttcttatttgaattattcgaaaattcatctctgaagtatttgaaaagtctaaatcatttggagcttacatcagacttcagaatcagcttctagggtatatttgatctttcaagctaaaataatttataaaaccattctatataaatagttatctaaaatataaattaagttaaaaaacattaccataagctgtatctacactcttttattacttttttataattagaaaaattagtacaagtacactgtaggcaatccagaaaaaaaacagaaaaagtataaggcaaaaaacaaaatcaccccataatactttcaacttataaactattatgaatatactggcaaattttcatctacttttgttttctacgcaaatacatttttacatagttgagcttatatactataatactgtctcatacactttttttattttgttttgagacagggtctctctctcttttgcccgggctggaatgcagtggtgcagtcatggctcactgcatcctctcctctcaggcttaagcaaccctcctacctcagcctcctgagcagttgggactacaggcacgtgccactgcacctgactaatttttaattttttgtagagatggggttttgccatcttgcccaggctagtctcgaactcctggtttcaagtgattcgcccaccttggcctcccaaattgtttggattacaggcatgaaccactgcacctggctgtctcatatacttttgcttacataaatgttttcctggcctggtgcggtggctcatgcctgtaatcccaacactttgggaggcagagataggtggatcatgaggtcaacagatggagaccaccctggccaacatagtgaaaccccatctctactaaaaatacaaaaattagctggttgtggtggtgcgtgcctgtagtcccagctactcaggaggctgaggcagaagaattgcttgagctcgggaggtcgaggctgcactgagccgagatcacaccactgcactccagcctagtaacaaagcgagactctgtctcaaaaaaaaaaaaaaaaaaaaaaaggtttcctttctcattaagttcttaaatacaacttttaaaggctacatattttgctgaacacaatataccaaaatttatttaatgttttctcaattgctagatattttgttattaatagtgctggcttgcacatcttcacacttaagtcttaatgcactcttcacattggtccctagaagcaggttatttttaagactattgattcatattccagaattgctttctaaaatattacaccaattagatttctaagttttattttatatattttaatacttttgtcaatataacttctaatcttttaatgatttctactttcgtaaacaaccacccttgctttctttttctttacttcacatatctttgcccagtcttgttttaaagctgtatcattacgtttccgatgtggctcttataacacatacagttgctgttattactaatctaatctaatctgaatgtctgcctttttccaggagagtttattatcataattgtcataattgctgtgggttttgttttgtttttcacttctcatttttctgctttttatctgtttcccctttttcctgtcttttgccatacaggatctgtatctactgcttttgtcttcttcagtgataaatgcaatttttcacagaaattatatactcataaattgagtacatactcaaaaatcatctttaatattgtattagtcctatgagacccaatttaacaaacagataactgcaatcagcaggacggacttgcttactgatactctaaaactcttgaaatcattgattcaattatttatagtcccttgtaaccttttttacactggtaatgtcattaatattatcctcttaaaatctggctagactgaagataaacttcatttcaacctaagtataaaaaaattaagtgtaagaattaacttggttactgtatatagtaatataaataaaaatacaacatattaagatagcatta

SEQ ID NO: 756 - DNA, 1421812 bp, Homo sapiens
ccctattttttccctctagttaagaaacccagtgacttcataacttttccactggaatatagcagccctaggtctggcctgttccctccccagccagtggttcatctgatgctgactctgacagctccctttcttcccatgcactcacccctaacgaccacaaataacacaaagcccaccacatccatgccacacaaccacccttcacgcctcagcccaaacccaaacctcacttcctcaaaagaaatgcctcttactcagagcatcagaatggacttctccttcacagcactcatctcaatttataaccgcaggtacatacgtgaagtgaccaagtaagactgtaaaatctgggagggcacagactctatatgttttccacttcgccgtctccccagggtttagcacagtacctggcacacacaatgaagcagcacaataaagctccatgaatgaacgaagaaatgaatgaactccaaaatcatataactaagcatacaccataaagaaatctaacacaaccaccgaattggaccccacaaccataactgaacacataagcaagcccctcgcactctaaatcacgtaaaaagtaaaaaaaataaaaataaaaaaaataaatatagctacatgttctgcagccgtacatccagcatgaatgtcaccccgccacatgccgcatcgacgacacatcccacagccgcactcaacccggcctcacgatcgcaaccacaacccacataactaacatgattatacacacatcgcatgaccacacacaacacgaacgactcaatcccgtgaagcagacatgacaacgtcacacatcgcacagacaccacacaaaacactccgaacatctccacacgaactcagaatacaaacgcttcagctttacacaaccagagaatcaaacacaaccgctcgggagacaagcacccacccactccacccacagctgcacaaccaaacccaagtgtatacgccccgcgtaaccgcacaaccacacagagcccaatcatcaaaggcacacacaagcgaaacgcacggcctgaaagccccatctcccacctctcacgtcacacccaccacaaccacacacggcccgcccgtctccgttctggaggagtcgtgtccccgccccccagactgggcctgaccctctgtatgtaccctgccgggctcctgcgggcacccaggtttgtcccccccttcaggcccgggctctgggcctccaccgtccgtcactcagccgcagccgccatctccatcggtcgctcggaactcggcaggtgcgcctgcggcggcgacgaaaccggaagacaagctggtagacgcctgtcgagcgccgagtcttcgagggcgcgaaaagggcggatacggattcgaatagtggagggcgggccggcggcttctgcgcaggcgctttccgaacgagggaggggatggtggggagcggagagaaagtggggctcggtaattttgtgcggttcttacgtcccgaattcgaactaatagcgcgtcaaagccagccaatggctctgcaccgccttgtacaggtgggaaagctgagaccagtagatctttggctcttgaccaaagtgcacaaagaataaggcagccaaggaatcaaagttcctgagagctagagacagaaaaaatattcaggggacgtggaggcgatggaaagtccaagaatagaaccacatgagagtggagacttggtatgagaaggtgtatcccggggtgtacagcatggccaagcctgtggaaaagatggcattttcaaaaggcaggacgattgatcagccaggacctaccccgtgcctacgctgtgctgggtaccacggggtatagagaggcaaaacctcatcccagtcccggagacctatttgctttgtgccctgcacacgttctggaccttagcaatagccagcctctaggagcaagagctgcagagaacgatgggacgatgggacgatcctgggcctccgtttacatccctgcagtgttactggcccccttttacagaagtaaaatggggatgataatgatagtctccgcttcacagtgttgtgaagattgaggtaattgcacggtaggtaggtaggtaggagggtgtcctgcatattggctttgcccatctcactttccctgcctccaaaaagtcttccccacctggtctctggacaggagcactgagcctccatcaccttccatttaaggacatggggctccggacttggagagcattgagtttttggaaagcaatcaccagtgaaagggcagtgaactaggggtctagagatctgggttctagccctggctgtacgttactttgtggctttgagcaggtcctttcccctttcttcgcctgagttctctcatctgtacaaaagaaattggctccagtgacttagccttttctctcaatctgatggccaatttttttttaacgttacaacatctgcaggagcgaataatgacttccctttgtttactgatggagacaaggaagaggcttcctaacctgtcagaagcaaagcaacatgccaagctccccgtctccatcactagcttctgccttaggtcccaaaagccaggactttgggagtaaaaccacccttttgaaagtctgaagccaccgaggtcccaaaacgagccacacttacaggcaggactatgttttgggtagggcaatgaacgtttattaaaccatcatgatttttgcttgtcattttatcatttacaaaaaacatatttggtcgggcgcggtggctcacgcctgtaatcccagcactttgggaggccgaggtgggcagataacttgaggtcaggagttcaagaccagcctggccaacatggtgaaactctgtctctaccaaacatataaaacattagtcgagtgtggtgtcgctcgcctgtaatcccagctactcaggaggttgaggcagaagaattgcttgaacccaggaggcagagtttgcagggagccaagattgtcccactgcactccagcctgggcaacaaagtgaaactccacctcaaaaaaaaaaaaaaaaaagaaagaaaagaaaagaaaaaaatatcatattcatcatttcatttgctcaaaaaagcaatagctatgtggcctcaacttgtaagttaattctggaaatcacagtggattgggcactgctcttgatattgtttcttttttttcttttttcttttttttttttttttttttttgaggcagagtctcactctgtcccccaggctggagtgcagtggcgtgatctcagctcactgcaagctccgcctcccaggtttatgccattctcctgcctcagcctcccgagtagctgggactacaggcacccgccaccacgcccggctaattttttgtatttttagtagggacagggtttcactgtgttagccaggatggtctcaatctcctgacctcgtgatccatccgcctcggcctcccaaagtgctcggattacaggcgtgagccaccgcgcctggccgatactgttaatgataatgacaaagaccttcctatatgcttcacacttcatcaaaagtactttctttaatcctttaggcaactctatgactatttccagtttgataataataaaaatgactaatatttactgagggatttgcacatgccagacactgttctatgtgctttccatatcttaactcatttcattctcacacaacccaatgatgtacaaactatacaaaatgtaataatattcccattctatagaagggaagctgaggcacagagaggttaggtgacttgcccagggtcaccagctggtgagccttgaacccagagtcaccttgccttgaggctttcacaatccccacttttccttcctctgtgaagtgctgatagacttcctgtacctcctcagcttcctccaggcaccactcctgtactgggcatagagaggggatgtaagccaattagttcaaaacagaaatgtgcacgtgcacacagatgctctggtgtgagaggagagaccagcagagtcccctgcaggaattcacgaaaggtttcccagaagcgggcagcacgtgagcatggtccttgggtagaaacgattgggaagggccttccaggccaggggaacagcatatgcaaaggcatagttatggagaagaacatgagtcctttgagaaactcacagaaaagttcattcacacatagagggatgatatcaagccactcctccttgttcccaaaactgtaggcagccacttctagtgagagaatcgtggacagctgggtctcttcacccttgccccctgccttagggttctctatctttctgtctctctatccctctctctatctcactctctcactttctcttggcccttatttgtctaagtttatcccaagcagcacaagacatcttggcaccacattaaaatccttgggcaagaaaataaattatgatatggataacataaacgtcattggggaaggtctgggcacatcatgtaacttcccgaagggccaactgccctccaggctggcctggccccagctcccaggcctctgccagctgctgtggtctgagccagcgggttgagggcattgaggttggcacaccctgtctgctggcacagagaaatgagggtgatgacagacagcctggcagagccttgcctggaggatggagggagggtgtgctgggctgggcagtgtctgagggaagcaggtggcagttgctgtggccctgtcaggaaggaagcagggaatgaagaaggaagagaaaacgaggggagaaaggaagaggaagagggagggaaagaatgacaagaaaaaagcgaagatggagcaaaagtcgacctgggtttgaatcccagccctgccacctgtggccacgtgaaccttgggcgggtcacttaaattctctgagcttcagtttccttatctgtgaaatgagataattatagtactcacctcttaggttggagggttaaatagcttaatatttggaaagtgttagaacagcgcctggcacaggggaaggactatgtaaatgtttgttaaataaagaaaaaggaagagcagtgtaattcacatgccttggctgttgtgttgcgctgagtcagacaatagcatgagggtgtgaggatccaatctggtgtcatagaaatagctttgagagtcatggccttgccagatgggatgtctccaaaaagaactcagaatagaatcacatagcaactagattcattaaatccaatagtgggtgggggaacagcctcagcaaacctgaaaagcaggaaacatggaattgacttgggagatgtgagcttcaaagccaatcagtttgcaggtagcgggctggcattgtctttgacaaagcaggaccactccaagcccattggggcctgtggcaaatgggaaagaggcaccactcccttctctcccatggacaaaaccttgtgctggcactcaagccctgcatttggcaaatggggcacatactggatttcagcatccacttacccccacccccaccctactcccaactatgctgcatacaacctgcacggtggccctaagtgcagggaggaggagaatcaagagcacagcatggtcctcaggtcacgagaaaaagtcacgctggttgtctgcagcttcagatctcattccctgacttacatcttcagagatacgcaccttcagccagttgagaagttaacctcaattttaacccagatttgaaacaatctgtgtgtatatggtattttaagtatttgagggatttaagagtgtttggcatattagagcatctaacacattcatctcatgactccagtttaaaatctgtaactcaacaaatgacttaggcttgtgattttaagttcattcaacaaactatgtattaagcacctacctacatgagtgcctgagataaacaaaacagacattgatccttgccctcagggagatgacattcgcatggagagacacagatcctaaacaattaatatactaaataagtatgttatatagcacattagaaaatggtaagtactatagaaaaaaaaaacagagtaaagagaacaaggagtgccaggttgcagaacttatagcgtggtcagggtaggcctcattgagaaggcaacatttgagaaaagacttgaagaaagtgagccatgtggatcccttggggaagagcattccaggcagagggaacagccactgaaaagtcctcatgtggaagtgtgcagggcagtttgcagaaaaagtaatgaggccaacacccatgtccatagcagtattattcacaatagccaaacgatagagacacctcaaatgtccatcaacatgtcaacatagaataatcaaaagagtcagcatgcggtctttttgttgttgttgttgtttttgtttgtttgtttttagagacagggtctcactctgtcactcaggctggagtgcagtggtgcaatcgtcccaccttagcttcctgagtagctgggactacagatatgcacccccacacctagctaatgaagaaaaaattttagaggtgaggtcttgctatgtcactagctcagaatgtagcttaaagagagtttagtcaaatgcaaaggttgaggactgcaccctgggactgcacacttccaagttgccttggcaaatgctctggagaacaaacaagaggctcaagtttttaatgagaaaaaggatgaggctgggcacagtggctcatgcctgtaatcccaactacttgggaggctgaggcagaaggattgcttgcggccaggagtttgagaccagccttggcaatataatgaaaccccatttctaaaaaaaaaaaaaaaaaaaaaaaaattgagttagaaaattagctgcggctgggcatggtggctcacagctgtaatcccaggactttgggaggctgagatgggtggatcacctgaggtcaggagttcgagaccagcctggccaacatggcaaaaccccatctctactaagatacaaaaattagccaggcgtggtggctcatgcctgtaatcccagctactggggaggctgaggcaggagactcatttgaacctgggaggcagaggctgcagtgagtcgagatcatgccactgcactccagcctgggcaacacagccgagactctgtctcaaaaaaaaaaatagaaaattagctgggcatggagatgtgcacctgtagtcccagctacttgggaggctgaggcaggaggatcacttgagcccaggtgtttattattattattattattattttttgagacagagttttcgctcttgttgcccaggctggaatgcaatggcatgatctcggctcactgcaacctccacctcccaggttcaagcaattctcctgcctcagcctcccaagtagctgggattacatgcatgtgccaccacacccagctaattttttagtatttttagtagagacggggtttcaccatgttggtcaggttggtcttgaactcccgacctcaggtgatcctcccgtcttggcctcccaaactgttgggattacaggtgtgaaccactgtgcccggccaagcccaggtgtttgaggttacagtgaactatgatcatgctattacagtccaacctgggcaacagactgaaaccctgtctcaaaaaagagagagagagaaaaaggacaaatccggagagcttacaattacagaagttgttcatcaggaattctcattggtttacagaaataacattggctaatgattggctacatattgttgaactatagggtgtatggcatttgatggctacttggtgtcagagctggcacagccaagtgggttcaagaggtaattatttagctcaaggaggagtgagatgcgactgctgttacattttattttttaatttttatttatttatttgagacagggtctcactctgttgcccatgctggagtgcagtggcgtgatcatggttcactgaagcctcgacatcctgggctcaggtgatcttcccacctcagcctcccgagtagctgggactacaggcgcctaccaccatgcctggctaatttgtccattttttgtagagatagggtttcaccacgttgcccggttggtctcgaactcctgagctcaagcaatctgcccacctcagcctcccaaagtgctaggattacaggcgtgagccaccgaacccagtctgctgttccatttaatttaatttaatttaatttaatttaatttttttttttttgagacggaatctcactctgtcgcccaggctggagtgcagtggcacgatctcagctcactgcaacctccacctcccaggttcaagtgattctcatgcctcagcctcctgagtagctgggatcacaggtgtgcatcaccatgcctggctaattttcgtatttttagtagagatggggtttcaccatactggccaggctggtcttgagctcctgacctcaagtgatccgcccgcctcggcctcccaaagtgctgggattacaggtgtgtgccaccgtgcccggcctgctgttacagtttaaatacctttctgggcctgataatttaaagtggttagcatttctcagaaaaaggttttctttctcaaacagatgaatgaataaacaaagcatggtctatgcttacaataaaatatcattcaaccataaaaaggaaatgaattttgatatctgatacaacatggatggatctttttcattacatttagtgaaataagtcagacacaggaggacaaatactatatgagtccacttatggtgagatatccagaatagtcaaattcatagagacagacaataaaataaaggctaccggggtgaggggagggagagttattgtttaaagggtacggagtttttataagggatgatgaacaagttttgagtatagatagtggagctggttacacaacattgtgactgtatttaatgccactgaattgtgcacttacaaatgattaaaatgataaatactgtgttgtgtatgttttaccacaataagcaaagtaatttctgggcgagatgtcaaagccctggcaatggtaagtgattggctcgcaggtagttaagaagagtttgcccacaacagtataggattgaaagggaaagttttataagatagaaagaaccctgcatcagagtgtggccggcgcctcagcaagagaggactgtgtgaaccacagtggattttcctcaggggcatttatggaccttaaagcgggagcttaagggtaatttggaccatgttagccacatcggtcataataaatggaggccgaggcaggagaatcacttgaacccgggagacggagtttgcagtgagccgaggtcgtgccattgcactccagcctgggcgacaggagcaaaactccgtctcaaaaaaaaaaaaaaaaaagttacacttgtagatattttggtgctttgatgtcagcaagggttgcacaatgagttttgacatgcatgcattcggagatgtatagaaattctggtttcttatacattttggggaaggaagcagggtactagataccagctttagatcatagggaaatcgaattacttctgaattcctcagatgaggagtgtcgcctctagatggtctgctttgtggccaccaggtgatctttgctctcctcagtgatgaggccagtgtggctggagcagaggaagtgagggagagagttttgggaaatcaggtgtgagagcccaagggtgaggggaggtcatagccattgaagggactttggcctttactatgagtgaggtgggagctgggggaagtgctgagtaggggagggacaggatgtgacctctgactgctggattgggaagagacacggaggtcggaaatgccaagtgtgcatggcacatagtaaacccttcagaaattcaggtgacaggatgcatgtagagtccctggaaggaaacaccaactgtaacagcgggcacctctggggagggaaactggaatggtggggagactgactttccacaacgtaggcttttttcctatgatttgaatggcttttttcctctatatgtatttttcttaaaaatatctaaatcaaaaaaattaaggaaaaggaaaataggagaagactgaaaaatcagcagaaagcaaaactgcggatggggtccccaagccacccctttctccaaagttgtttccccttcatgcacctgtttgctcttctgcgataagggaggcacttgacaggctcaaaagcctcatgcccagggaagtcgtttgccccaactcgtagcctcaaatgaacccccactttgctcacagttgggggtgggccccctccagttctagcttgtgggctgtctagcaggtcagtgagggttgtaagtagccttgccagccaccagggggcggcatctggccactttagaaccttgcagcgaacccgggtgtccaaagccaacgtggttctgctggtttatctccaatgccttccaaggctccctcctgctgaccaccggaggaggctgagcatcccagcagcctggggtgggagactcagtccctctaccacgcctctgcactgctgcccctttcctcttttaggggctcgccaagtagctgataacagggagccaggatgcacaacacgctgtcatgttctggaccagccttggaccttccacagagccctgggttcttttatctctggggccccacccctaaacctgctcttcccacagctcttccatccatgtgctctggccaagaaccgtggagtcatccttgacttctttctctcacatcccactttttttttttttttgagacagggtctgactctgtcacccaggctggagtgcagtggcgcgatctcggctcaccacaacctctgcctcccaggctcaagtcatcctcccacctcagcctcccgagtagctgggaccacaggcactcaccaccacgcccggctaattttcgtatttttttggagagagacagggtctcactttgttggctcaggctggtatcaaactcctgagcttaagcaatccacccacttcggcctcccaaagggctgggattacacgtgtgagccactgtgcccggcctcacatcccacttccaacccatcagcaagttctgtcagcttttactttggaatggatctagaatatgcggaatctagaatacacttctcaccacctcactgcctatatacagtgcccttgacataagtaactccatgttagaaagattccatcttacatttcaaaaggcatcatgccaacagggaccagatgtctgcctcatcaacagaaactgcacccaatcaggcaagggtatggccacacacactttactgtcagctttcaccagaagactcaaggaccattaaaaaaaaaaaaaaagcaggacttcagcagttcaactcagacatctcactagacactgtcttgatgtcactcatggtcagcacccggcatctgccactgaaagctccacccaaatcaaggactcttccttgcaagacactgatgactgtcagaatcagcccagaacactctccatgttcacatcaatgaaccagtccagctctccttggaatgattcattaaccccttttcctatcccctttcccttcgtgttaaatgttactctgtttgatgtgaaatttttaatctataatatttacatgttaattacgaatactgctatgacggtttgcaatattgactgacctgtggatcggcttggacctatgtgcccgtggctctgactactgagtgagcgggtaatactaagaattgcctccttgggaacttcttgtagctcatggcttttatgattgaataagcatcaataaaagtctgaccttgggaaaggcacaaacgtgtgtggacctggttatgtctgaccttgcactgctcacaacaattggcgtagttagcagctgtccttcagtcagacaaatgtccaaaactaaaagcagccatttataatcatataactgtgataaccaaattgggaaaattcctaaagccaaatcctccactaaaacttaaattaaaaatcaagccacttggcgaaacaaacgaccaccgtctctaaaaagagataatctcacttcatgttgaaagtctcgctccctaaggaaaaccttgggtaatggggtggaactaacccatgtcgtgcacatccaaaggccgatgaagtctgggctgacaccaagctaggaagctggtggagccggaagggctcgtaccaaacagggtttcaacttacgagacagtggttggcaaaacaactttaatctggcagaaagaaaggaacgtcaataacctccactcatactattggttaaggtgggaaatggaaatatttattattaagaaaccatataaagtagctattaatattgcataatgtgggccctaggaaagaaaattaagcaggcatgccagaaggcttgtcacccaaatacagtacttagtgttgaataccagacagagttggaagtcaggaaatgactccctgtactatcccctaaggatgtacagtcagactcgaggctcgcccctccaaatgttaaacctttgattagcagagccgcaaaagaagaaatctctgcacttttaatgcaaagcatcttacagacagacagggatcaccagaaaggcaaagaggtcgttcatagaattttaagcaaaagtaaatccttttcagatgtaacttttgaaaaggaatgtctgggaccaaaccccccatccagaggacccgggagattatgatgaccctgggaggcgggcgcatgtggcaagacctataataactagaaaaagagttatagattatgaccgtggacatgacagccctcaggacatcactgagatcacagaatacatcaaagcagaattacgacaactaagaacaaacttttgctaaagacggaccacagatgcaaactggctcctctttatctgtgggataatggagcaaacaccatagtgctcccagctactcaggaggctgagacaggagaatcacttgaaccggagaagtggaggttgcaatgagttgagatcacaccactgctctccagcctgggtgacagagcgagactcagtctcaaaaacaaacaaacaaacaaaaaacaaagattctagaattcctcaaggaagcaagaaagatgtgattacaattggcatttcaaataactttaataggccagtatggcctgtcctaaaacaaaacaggaactatagactttgttatggaaatttaaatatattctcacccaaaatgtctgaggcatttccagatgtagaagatgtcattaataagatcactaactccagtgggaaatactatgtaaccatagacggtcagacgtgttctttgccataccaataaacaaaaaaagtcaggaaaatagctcctttacttgggaaggcaaaaaatacccaatttaaaagattactgcaaagataattaaataattcagtaatagctcacttcatttcatcatcacacatagatcaattaaaatatgtatcactaaaaatatcatacatagatgacattataatggtaaacgatgaccaggaaaaacttaagcaaaaaaattcccaattaataaaacacttaagatcactgggatagaccattcatacagataaaaccataggcccagacaccgattgcaaatttttagtagtacaatggtcactggaaagaagaacaatcctgatcacagtgatagataaaataaaagtccttggctgggtgcaatggctcacacctgtattcctaacactttaggaggtcaaagtgggcaggtcgcttgggcctgggagtttgagaccagcctgtgcaacatggccaaatcccatctccacaaaaaatacaaaaaaattagccggttgtggtggtgcacatctgtaatctcagctacttgggatgctgaggtgggagaatcgcttgaaccgggaggcggaggttgaggtgaaccaagatcacgtcattgcactctagcctgggcgacagagccaggctctgtctcaagaataaaataaaatcccttaaggtgccaaacaacacacaggaagcaccaagatgaacaggtttatttgggtcctggaggcagcgtacgccttacttaaacatcatcctgaaaccaattataagataaccaggacatcctgagacttcacatggggaagtgaacagacacaagcacttgaaacactcaaagactacatcgccacattccaaacacggcatcacccaactccagattcactacttaagtcaggaattctgatgagtgatgaatatggaacacagtcattatagacaaggaaaccagattctacatccttcttactggtcagatttggacaacaaaattcccatactctaacaacaaatacagaccatttgaaaaatacatatggcttacatatgaaaccctcaaaacactgagcctctgattggcaacaacaatgttacaattacatgccatatgcttctcctttacaggataaaactgagccctgaggaactgacaggtatccaaattgatccaaagctgctcacatggaaatggtacatctagggtcaagacaccggctttaagggtaaaccaggcctcctcactgaggacattcacaagactgaaacagacttgctggagtttattttgaggacagggacaatccctgccaatataggtaaatgtggcccagtctggtctaatgtcttgcccagcacctggtttacagaaggatcagcctttgtgattcaaggccagcagagcactcagatcccaggaccaaaggatcccaaaggaggcaggtatatcaccctctgtacagcatgcagacttgattgcttttgtcctagtagtaagacagtgtcagaaaataaaaaaaatatacatttttacaaactcatggacagttccgtatggcatagccctatgttcacacaaatggaaacaaaataaatttttttttttgagttggagtctccctcttgttgctcaggctgaagagcaatggtgcgatctcagctcactgcaacctccacctcctgggttcaagcaattctcctgcctcagcttccaaagtagctgggattgcaggcgcccgccaccacgcccggctaatttttatatttttagtagagatggggtttcaccatgttggccaggctggtctcgaactcctgacctccggtaatccacccacctcggcctctcaaagtgctgggattacaggcgtgagccaccgtgcccaacacaaaataacttttaaattaatggtaagaacatgcggtccaaaccttactgggaagaactatataaatcataaaacaaaattaaggtattaatgtatgagtacaccaaaaagataattcagtgaccacaaaatttagggatcaagtagaggcattaacaggaaacataaccagtgacacacaaaacatacccaagttaaagcaacacagaaatccagaaagctcgtggagacattcattaccacctctacaactcaggaggaaatcagacaggagtgggagataccaagggaccctcaatagctactaaaaccgggagatggctttaaaattaaacggacaccggaagcagcttacactccacaaacactcctataattacataaagaaaaaggacatttaggcacacactcactgtataggtggccatcagatggaaatcaaaggatggcatgacatcgaatgtaaaaggctatagctaactgaggaatgtgaaacctgacacctttaacatctgctcacagatggattttatcggaccattaagccactcctacctgcaaatatacgcagtaacaatgggggctatatacacaaggactagcacagcaatagcacctggccacccattgcctaaatctgtgctggcacataatgggccctcaacaaacatttattgaaggctcaatgagtgaatgtgcaatctcaggcaagttgattaatctctcagcatccatttccagttctgtaaaatggggatgataacagcccacacctcacagagtaatggccaatgctggtgtccctggcagggaggggggttcgagggggaaggcagaggagacctctctccatgaagtcattcattcacaataaagccactgtcattttcaatatggagcttccaaggtcacgtgggagttggtgtccagccaatagatggaagaagagagaatggagaaagtacctccacttctcatccatttgagcggaagcaactcatcactctctctcaccttcattggtaagaaccagtcacacagtccctcccagatgcagggagggctgggaagtgcagcccctggcttggcagccacatccctttaacagcctacaccaggaagagaagcatacatctctggtggacagctggccatccctgcctgaaattctttctcaggttgaaaccatccttacagggataacaagcatcacatgctgggttctgggcagaaatatagtttataattaagtgttaatcaggctgcgctttggcccacttctttggaaccaaaagtcatgttaacactagacactgaccatttgcaaacccattgttcctataagtaggaccactgaggttagaatcataaggcttttatttaagaattgcttaagatgttcttcagtgcgcaaattccagcagagtggcagaggacagccagcatgaagacccccacagaggaacgggatcagcatgagaatgcagtttcttcatctccctgtcccaagacttcaccctgcactcttcgaccaatcaacgacctccccactttggcccactccaaaccccttaaaatccctagtcctaaattctttggggaggcagatttgaggtttcctcctgtctccttgtttggttacccacaattattaagctctttctctgctgcaatccctggtcttggtatactgacttgctgtatgtcaggcaaatgatcctattacaaagtgagttccaaactccgtgaaaacctctggctgagcctttgtcaggctgtcaggttaccaagtttagcaagctggtgtgagaggctccatccaaatacccacagtgtgtaacccagttgatacctagtgtcaccagcccagggagaagatccccctggattaaaaaagaaaatctcatggcctcagctcctcccttcctctctctctctctctctctctctctcttgctctctttctctgctccctccacacctctctctttctctcagtcatgagaacacaagctgtcctagcgtatctttagggttaggtttctgcctagtactttcctgcccaacagatcaacccagtatggctaaacacagcgaacttgcaaggatcataagacgctaaaaatgatgaaagacgtgaaaaagcatctgggagaggccagggttttccctacacgttagggctcctttcccactgcctttgcgggtagtcaaatcccacctactcttcactgggtgctccttctcacgtccccaacattcttggtgttgtagtggacagctattgcttttttctcagtggcatacaattctctttctacataacatctccgtgtcctgggggacccaccctccctggtctcagtctatttcaggtaattttctttttctcttttcttttcttttcttttttttttttccgagatggagtttcgctcttgttgcccaggctagagtgcagtggcgcgatctcggctcactgcaacctccgcctcccgggttcaagcgattctcctgctcagcctcccaagtagctgggattacaggcatgcgccactacgcctggctaattttgtatttttttagtagaaatggagattctccatgttggtcagactggtctcgaactcccgacctcaggtgatccacccgcctcagcctcccatagtgctgggattacaggtgtgagctactgtgcccagcctcagataattgtcttaatccaaatgctacaacatttgccatctaatccagatttaaaacccagctaggccctgtctttgtgcagcctcccacacccccactggcctctcatctctgcagagccttctttcttctctaaagctcctgtgcccatctctgataagctcctcaaaatcactgtgcacagggtatcttctgggaagagagagaggcctcctgtgctaggcactggcccacatgggctgagagttaggaggctggtttcaggaggggagtcacttgttacagagctgcagagttggctattgctgtgtaacaaacatccctaaacttactgactttcaacaataagcatttacttttcttagttcacagatcagctgggcagttcttctggccttggctgggctttctcgtgcatctgagattggctgtggactgagggcaggggcagccctgcgggtcttagcaaagctctctcacctattctggggctgactggtctagaatggcctgaaccaggataaatgagttctcctccatgtgctctgtcaactgccagcaggctggcccaggcttattcacaaaaagataacaagcagaagcacaagaggtcacttgaggcctaagctcatactgtcacattatcacttctgctgcattccagccttttactggcaactcccaagtccagcctagattcaaggagaaatagacccacctctttctggaaggaactaaaagaggcagagggtttgctaggctgccatgacaatgtaccacagactgggtggcttaaacagcagacatttatttcctcacacttctggaggctgaaagtccaagatcaacgtgttagcagggtaggtttcttccaaggcctctctccttggcggtctttgccttgtgtctttacgtgtttttccctctgtgtgtgtgtgtcctaattccctcttcctataaggatcagggccctccctaatgactttgttttaacttaatcacctgtttaaagaccctgtctccaaatacagtcacattctgaggtactgagggttatggcttcaccataggaatggggggtggggcacgactcagcccatgatagagactgggccatttttgtgctcagtataccaccaatacctagctctattctaactaaaatgataaccctgcaaggtggctgttagtcaccaatttacacatcaggaagctgatgtttggagagtgtaagggacttgtggggccaggatggaagccttggtcctcctgactgacaggctttcacattctcttttccccacactagtgtgtagcaggagcaggccctaggctggacatgggtcatctggaaagctagttgttcctctggcacaagctgataggaggaacagggcaggagccagccacgtggtgcctccagggtcctcttccccgctggaccctgcctcatggcaaagcagacacagagaacacccagttctccttccctttccctgaaagcatgctgtcatttctcagaagtgtgacccttgagttcgagaccctaggcgcacttcacagagccttgggctgagtgccattcatggtcagttccagacacaggtttctagcactgatggtgtctttccctcattctaatcagactgtgttctatttatggcagaagctgtgccacttttctgccaccctacctatgcacctgccattcctctgcctagtgtgcccttccctcttctcctatctcctctgagcctgacaaattcccatttcaaagggtctgctctgctctaaccctcccagacagagatgacacttcatcccttgtgagtcctcaattacatatatatatgtcccaggtctgtcaccccaattagactgtgggcttctccaaggacggagccctgttttagtcatccatgcatcaaccacatcccagctgtgagaacttgagtaagttatttgccttctctgtgtatcagtttcctcacctacaaaatggtaataataagaaccttcctcttattgcataaggattaaaagagttaataggtgcaaagcacatagaacagcgcttggcactcaataaatgtgtgagctattagtattttctgttcttctttttttttttttttggtttattttttgagacaaagtctctgtcacccaggctgtagcagtggtgcaatcatggctcactgcagcctcgacctcctgggctcaaacgatcccacctcagccttagagtagttgggaccacaggcgtgcaccatcatgcccagctaaatttttttctaattttattttttgtagagacggtgtatccttatgttgcccaggctgatcaccaactcctaggcctaggcaatccacccatcagcctcccaaagtgctgggattataggcatgagctaccgcacccagcctattattttcttcattactttctagagtgctgcataggaccttataaatgtgagctattacgctttttgttattatccctcagtgccctgcacggggttgggcccaggaattatttgctgaatgaattaattactgtgctatgaatgaccttcaccttcatgagcagaagaccatgtgtggggaccgtaagacttcaatcagggataaaacaggaatatcaccaagtgcattagacattttaataagagccttctccgcgcccccgtggtgtctggccgctgtcttccgctcctatttttgtttgggcctgggtggcactttgaggatcagaatttggggcatcgtcttctgcctgcgtcctgagcctatgctcccagccgcctgctttaaatagcctcttcctgttcactgttcttactcagcctggagcaaccaacctttccggcacgttgagaccccgagtccgggagcaaatcccacctgagcgcgagcgcgcggctcctcccgccagcagggggcgcccgacacttgccttcccccacgagaggcccggggcgctccgggtggaacttgaaagaattctgggccgggcgcggtggttcacgcctgtagtcccagcactttgggaggccgaggcgggcggatcacgaggtcgggaaatcgagaccatcccggctaacacggtgaaaccccgtctctactaaaaatacaaaaaattagccgggcgcggtgacgggcgcctgtagtcccagctactcggaaggctgaggcgagagaatggcgtgaacccgggaagcggagcttgcagtgagccgagatcgcgccgctgcactccagcctgggcaacacagcgagactccgtctcaaaaaaaaaaaaaaaaaaaattaaccccattcgaggcaggtgtgaaatgatgggttggaggcactagtctgttttctttaataggcttttaaataaacactgcatcgttaaagcttaaacctatggaccgctcagaatcactctgtgcagaaccaggggccaacctaccacagctgtggcagaggggggccacccagcaaaggaccgtgcagtcggggaataaaagctgccatccagggttgcgcataaagggaggtgagggatctctcccaggtcaagaacggcccggatctgctataaatgcttagagaagctctagcagaacactcgagaaactcgtcaaagtagctacctctggatcttctggatttttttactttaaaaaataagtctctctttatctgtcttttttaacagacaggacctcactctgttgcctaggctgtagtgcagtggtgtgattatagctcactgcagcctcaaactttctgggctcaagcaatctgcccacccctgcccctcgagtagctgggactatgggcatttgccaccacactcgggtaatattttaattttttgtcgagatagggtctcactcactgtgttgctcaggttggtctccaactcctgccttcaagtgatcctcccaacctcagcttcctaaagcactaggactacaggctgagccactacaccaagccaaaataagtcatttctaaaatttgtcatgggattagagaaaattaaattaaattaaaatataaaaataagtaagtctttaaaaaaaaagaaacaagaataagttaacagaaggaggtgttcaagtggagacaccagtgccacagctctgactttggctaagagtacccagccctgtgcagactggagaggtgcagaattgggggtggggcacctggggttctggttacctaagaccatctgacctctgcatgggatacttaggctttcacagggctcatccaggggagttcctgcaaactatcatgcccctttctcggagttccagccctgccaggggctttctgaagacttgttggctgtcatcccattcctaggtgcctcgtcctgcaagagaaccaggctgagcctgcccagggcaagcaggaggcgaggaagggcccagtctctgtagagttggagaaggcagcctgcgggctcctctgcagtgagctcacagggcctgggagcccagagggcagagcaaggatccacagggatgtcagggggcagtcagagggtgccaggtctcagctcagagagaaaaacactttcttcccggcagagctgtgctggttagaacagctgtgctgtgtctgagggaatgaggtccccatccctggaggcaggcaagcatggactgaggaaatgtcgggtgagggaggttagggagaattttcctacctgcactgacctttaggcctctttgagtgctgagcttttgtgatccaattccctgacacaagcccttcctcctcctcgtttgctggtgggcaaaatgtgagggaaggtgaaagacgccctttgcctccacgccagctccttgcctcccaaagaagaccctagatggactgggagcactgccgtgtaatgattagggagatcctcagggtcgtctgacatcaaagtgttgtttggtgcaagaacttggtctttcaaaagtactttcgggagcagctgggtggaaaaaaaaagcaactttaggaacttgtgggaacacttgctacctccaaccagtgcctctcagagcaaatgtggggcctccgtctgttcaatggctcttagttgggtctcctgcacgccttgagcctccaggatataaaaactgcaatgaatttagttcaattcaaaataagtttaaattttaagttttgtgataggtaataacaattgtatggtttcaattcaaaaggtgggtaggtgaggtcatttagccaaaagtgagtctcactttcatacttctccaggccagcaggccctctccagggcaaccaccaatgcttggcatcctcccagaattcatctgtaaacgtgcaaacaaatacatacctctctcatgaaatgtgttttgagcacctgctaagtataggggtgaggggtgagggagcccagactagggagtcagccagcctaggttcacacaccagttggtaatatttggctgtgcctgctggctaagagcaaacgattacttcctggggacaggcactgctctgtgatcttgcagtgtgctctctcattcaattctcatcatgtgctagttggaggcctttgcaaaacagacaccaatgtgggatcagacgtgcaagagatttattggggaaaatacctgtgaaggaaaatggggaaggaactacttgaaggtggccaggtttagcaaacaaaaatacaggacatccagttaaatttgaatgtcagataaacaatgaatacattttactataactacgtcccatgccatatgtcccatgcatactcatatttaaaagtattcatcgataatctggcattctaatttgactgagcattctatattttgtctggaggcaactgggagagtcatcagaccatgaagcaggtccgacctctgtgggaaggagagaaaaagaaggaaggtggggagggtagtgggctgataatggcccccaaatatgcccgtgtcccaatcccctgaaccaaggaatgtgaccttacatgaccaaagggacttcgcagatataattaagctaaaaatcttgaggagattatcttggattatccaggtggccctaaatgtaatcacaagcatccttataaaagagggaagcaagaaggtcaaagaaggaggtgaaatatgtagcgatgacagcaaaagtgactcaagcaggggccatgatgaccaccaaggaatgcaggcagcctccagaagctgaaaaaggccagcaaacgaatttgccccaaaagcctccagaggaaccaaccctgctaacaccatggctttagcccagtgaaactgatttccaccatctggtgtccagaactgcaagataataaatgtgcattgttttaaaccactaactttgtgctagtttgttatacagcaaaaggaaactcatacagataggaaaaatctcaaattgcaacgcagttctaagtgtcagcaaggcccatggcaagtcctgtcttacagggagaggcctgcattagaatccttgacactcagtcactggctgggaagagcccgtgggaacctgttctcaatgcaaatgtacttccttcagagcaaagcagttgaaccaatcaattacactcccatccttggaaatttgagagatggatttttatggctgccatatactgcaaccctattattctcattctaccaccaagaaaccagtgcccagagaggttaagaaacttgacaaggtcacacagcctttaagtgtgggcctcagaccattcatggtggtggtggtggggccgtcctgtgtattgtaggatggttagcagcatctctggtctccatcctgtaggtgccattctaccctcccatctatggctaccccagatgtctccagacggtttcaaatatcatggagcaagggagtggtacgtgagcaaaaccaccctagttgagagccattggtctacaattgtggaaatgtttgagggtgagagtgtcgagcttgggtccctgctgtaccctttatgagcaatgcggtcttggaaaattaatactactccaggggcctcagttttctcatctataaaatggagataaatgagatacactttcataggaaggttatatgggatttactgagataataagacagtacatggaaaatgctgggcatagaatttatttattttattttattttaagacggagtcttactctgttgcccaggctggagtgcactggcatgatctccgctcactgcaacctccacctcctgggctcaagtgattctcctgcctcagcctcccgagtagctgggattacaggtgcctaccaccacacccggctaatttttgtatttttagtagagatggggtttcaccacattggccaggctggtctcaaactcctgacctaaggtgatctgcctgcctcggcctcccaaggtgctgagatcataggtgtgagccaacacgctgggctgggcatagcattgtaacacagacaaagcacaaaatacttgggcaatatctttttacatttggcttgtctagactccatcctccatcccctcatgcgctggtacggtgcagaccagaatatcacccacctagactgcagagtggatttgggtggcatcttggctttctgcacaagacttgcctgttccccaccacatccccctggttctcagggtccaggattccaggaggcagggatgtgggcaggcagggcagatggcccacccagttcactcccacgctggggacctgcagagccggctctccaagacagggtgttttgaccagcatccaggtttctggatttccatttgagcacagctggactacacaggctgaagctgtctctgctgagatataggtatttccctggcgatgacctttcaagctgacatgaagacatggccacccgctagaacgtggtgtgtctgccgtggcgctcttgtaatttgtgaggcaggctcctgacgaatgcagtgcgtaagtgggaaatggtgggaagttctctcatccccccctggccaaaagtgctgcctgcgcaggttggtggacggtcctttgagcaggaagaagacacggagcacattcctgttagctacgacaaagaggggcagggtacatactggacatttcaagcccctgcagagaagcaagtcttactgtgctgggagtacttgtggagtgggggctgtgttgccctgggctttaattatttcaggaacatttaaccgcagggccggcaggctggatcttgatatgtgtttctcagttggaaagactttggaccatagggaaatgtcttctcaattcttttaatttcattaaggtggtcagttttcttcttgtggcctctggaatgtgacacagaactcaagggacaggaaggagatgagttggaggctgggacaggggtccctgccagggatgctggtgactcacatgacggtgttgatgtgtggagtccggtgcctggtttggggaatgtttgtgggatatgttccaaagcactgatggacctatcaggtactggaggtgaatggtcaagtctgatctcagggctggtagtgtcaggcaaggacaggaagtcgacattggactcattggctgaggttgcttgggacccagggggcaatgtgtgccaggacagatgggtctggggctaggaaggcaggtttgggctggagactcgggcttgggaggcatcccaggtagacaatggttgaggctgtggaaatgactgtgattgcctgggttgagagtggagacagacaagatgggggttttgctctaagcctggggaccccacctcccaggttcaagggattctcctgcctcagcctcccaagtagctgggaatgcaggtgtgtgccaccatgcctgactaacttttgtacttttagtagagatgaggtttggccaggctggtctcaaactcctgacctcaagtgatcggcccaccctggcctccaaagtgcgggattataggcgtgagccaccatgcctgaccatttttaaatattaatttttatgaaatattttcaaacacattttactgtacattggaaaagtcaatcatgatttgaaaactttatcaaaatccaatcaaatgtcaattaaccatttaattgtggatgggtagggagactattttgaccaaaacatgttagaacaattaccacttatagaaataatctatgttttaatgttttagttgaattaaagaatcttttatattctatccaggcgcagtggactcacacctgtaatcccagcactttgggaggccgaggctggcggatcacctaaggtcaggagttcgagaccagcctggccaacatggcgaaactgtctctaccaaaaatacagaaattagccaggtgtgattgcacacacctgtaatcccagctacttgggaggctgaggcaggagagtcctgtatgaggtcggtgctgtgattatccacatgttcacttgttctctctggcctctttcaggctcttgcacttcctttgctcttttcctgccacagggcctttgcacatcctgctctttctgcctggaaagatttttccctctccctgcctcttcacctggtcacggtctcatctgacagtggagtcactacatcctcagggatgtctggccacactgactcagtcacagcaaccccctgttatctgctttcatgacaccaggtgcctctctgtggtagacactagctcagctacggcttcctgtttctgtgcgtgtcatccttccccttcaagactgtggtcaccgtgagggccagggccatgcctgttcctgattctcatttgtgtctctggtgtttagtatatgcttacctagaatttgattaatgaatgacggcatatccattttacagatgagaaagttgaggctcaagaacatcgtgtaacttgctcggtattagatagtgatggtttgaagcgatctggctggtcgctgggtgcacactcttaaccacttcactatggttcttctctcatggtagctctccaacagcaggagtgagagacaactttaggacaggtgtaaccagaatcccaggggttatcctagaaggtggtgtcaggaacatgcttgcctatgggccttcttactgtattgcataaaatactcagtttttctgactcgcctttagtaaagaccttagcaatatttgaagcacagttgtcagtaggaaagggtgggtgtttatacttttttaaaaaggagtctatatcatatttatcttgtggtctgccatgcccaccgctcttcttcagcttcagttatgcaaaattcacacttctcctcttgactgcctctctcttacctgttcagtttcttttctgtgttcgagattgcttagaatttttccccattactacagcctgcttcccacctgtatcccccagccagcttgttctggattttgtcaacaacagttccagcgtttagtgagggctggactgaaggaaagccttggaaaaggctgcgtgatgaaaggtgaagatacctaatgggcaggcagtcatcagggttaattcaaaggctggaagaagggctcacctggaggactggaaatgtctttgagctgaaggtcatgtgcaggtggaacgaagagggtgagccttttggggtgaactgcaagtatttgataagatccctgtccccatggttggggaagtcttgataagcatcctcaatgtgatggaaggatcaaggaacccgtggctctacctgtccagcatggcagcaacatgacacagccaagttattgattattggttgcccagctgtcatcactcaacatcttctgttagttatagctgtaatttgcactagttgtcaatgccagttttgactttcctagtcaataaagtgttcggagagtggtgactaaggctgagcactacccataatcatgagtattacagaggcaagcccccttgcccacccacctgcaggtgatgacacaccctaggaaatcactcaattctttggaggaccctgaataaaagctcaagtccatctgttcatctgtccgtccatccatccaccattccatccatccatccatccatccatccatccagacatgcatacatccatccacccacctacccatctatccacccaccacccacccatctatccatccaacccactctcttatgcacccagctatcatccacctagccacccaccaacccatttatacatccactcacccatgcatctatccacccattcactcatctacccatctatccacccacccgtggatccatttatctatccctccaccccctcactcactcatccatttctccacccactcagccatcccttcaccgactcaaccatccattcattcatccacctgcccacccacccatctttccatccacccatctatccacccacccacctatgtatccatccactgcttgtccttctgttcatttattccacaaagactcattaaccacctactagattctggggaggtatctgctctagtaattgagaacatggtttctggaatctgattccctgggctcaaattgagctgcctcctagctagctgcttgggtaagttatagaaactgtgctttgattttcttatctgaaaattggctattaatagcttctactcttgcagatatagtgaggattaaataagatgtcacgttaaaagtgcatcatcgacactcaatagagattaggttttaccattcattattattctttgcagatgctgcagataacgtggagagcatatgaaaggcacatgttttaaccaatagtgacatacaggtgctaagttctgcagtaggggaagggcagaaagccatggagagggcctggcccaatcctggagcctcagaaaaaagttcgcctttgaattgctgttttagctgagacttagtagttggagatcccagacaggaggtgacagagttagccagggaaaaattgggtcctggcacccatggcagagttgagtgatccagtctttctctctcctctggctggaagtccaccagatctgggaatgtccagttgggggagggggctgacaatgatcatgaccttcacctgtcctcacatgtcctctgtgtatctgcaaagcctctgcctcagtctcctcttctggaaagtgggattggaaaccacatctgcttctctcccaggacttctaggaagacaagattagatggcaggtgagagctctttgaaaatgaaaacattctgctatttgaatgcaaagtgttcttctttgcctgtgatgtttcctaatctgtgaaatcatactggacctcgaagctgtgtattaaaaaaaaaaaaaatagcaaagtggctgggcagggtggctcatgcctgtagtcctagcactttgagaggctgagggggttggatcacttgaggccaggagttcgataccagcctggccaatatgtgaaaccccatctctactaaaaatacaaaaattagccaggtgtggtggcatctgcctgtagttccagctactcaggaggctgaggcacaagaatcatttgagctcaggaggcagaggttgcagtgagccgagatggcaccactgcactccagcctgggcgacagagcgaggctctgtctgaaaacagaaaaaaaaaaaaaaaaaaaaaaaaagcaaagttaacacttcctccatctctcccctaggggaggcaatttgtcaaagattgttgttggattttacacacagggaaatctaaggaaggtgtggaaaccagaccaggactctcgtctccctgtttacagggtcttaaatgggggagccactttgggttctttccacaagattgctttgtaaaaaaaacaagaaacaaacaaaaaactcaaaaaaacagccctgacctaaatattcacaagggaccttaggcaatatctgcaaacaaaagtgaatgatgagtggaatctgtcatctttacaactaagacagctccagagttgaagcaagtggaaatatctctagagacagagacttgggcgggttttgccagttacaagctatgagaacctgggcaggtttacctctctgagcttctgtgaccttgtaaaataggcagctttgcgctaaacttgcaggaggaatcccagcatcctcctgtgcacaaggctggtttcttcccatccttttccttgttctgcctctctcctcctctccaagaaatgaatacatttggacccagtaggggcctatgtttgcaaaagctcgcaggtgattctcatgcagccagcctggctctggcactgaggtcttggacacttctggaggcacatttactaatgaggaaggtcactgtgtgctgaaggcatgattcatcttccattcctttcttccatgaagcaaggtgcatgggttgactgagctgggagagtccacagtgtcagcctcccccacgcttccctccctccttattccttgtgtgctgtactttgtcttgatttcctgtactctgcatcaagccaggagatggtaagatctcaaaaaaatcatttttttgggaaatgggactaagagggttttggtttgcctgtttgtttgagacagggtctgtcacccaggctggagtgcagtggcgtgaccttggctcactgcagccttgaccttctgggctcaggtgatcctcccacctcagcctcctgagtagctgggactgcaggtgcacaccgccatgcctgattaatttgtctattttttgtagagacgaggattcaccatgttgcctaggctggtctcaaactcctaggctcaagcagtcctccatccacctcggcctcccaaagtgctgggattacaggcatgagctgctgtgcctggccaaggtttttttttattattattatgaaaaattttcaatatacataaaagtagagagactagtttaatgagctatcatatacccatcacataggtttaaaaactgttaacgtttgcaatatttactccatttgtttttctgaagtatttaaaaattagtttacagtagttttgtaattgcatcatgatattcacccctacgtaatttactttccctttaaaaacatgagggcattttttatatgatcattgtcatacctaatcaaattaccagtaattccttaatatcctctaagatcaagtttacattcagatgtcttctcctcaaaatgtcaattgtgattattttttctttgagcaaagataataagatctcaagatttaatgacagagattccatgttagccctgatgtctaagctctgtggtccattgtggctttacttgaaagtctcaggctaggcgtggtggctcacacctgtaatcccagcactttgggaagccaaggtaggtggatcatgaggtgaagagatcaagaccatcctgaccaacatggtgaaaccctgtctctattaaaaatacaaaaattagccaggcgtggtggcggttgcctatagtcgcagctactcaggaggctgaggcaggagaatcacttgaacctgggaggtggaggttgcagtgagctgaggttgcaccactgcactgcactccagcctgggtgacagagcgtgactctgtctcaaaaaaaaaaaaaaaaagtgtatgtgaggaaactgggatagagcttggggatattgggggatggaggtacttcatctactgaacaaaaaccatgggataccaatgctagaggaagaagcatcatcctcagtttctactaactcaaccatgcatgagatggggacttggtgtccaagagaagagcctctttttaggtcttcagccttggtcaaaccatttctgaattcctcatacacatataatcaggtgctatgagtggtactgattggataatctttctgtcgtttcctgtgctaggaaggaaaatacatgtacagccaacttccttgagggttcgttcttttgcatcagggtgtctcaaactcctgcccttaaaacacctgcaagagaatcatccaggcggcttgctcactctgcatgcagaccctttagaatcagagtcagaatccctggggctggagccacaaaatgaaatgacatttcaacaagtttgtcatcacgtaagagagaataggtgagtatttggatacctataatacaaagtagattcaaaaagaatgacgattattttaaatgttgtgtttttaaaaatttaatacagaaaaggctgggcacggtggctcacgcctgtaatcctagcactttgggaggccaaggtgggtggatcatttgaggtcaggagttcaagaccagcctggccaacaaggtgaaaccccacctctactaaaaatataaaaattagccaggcggtagtggtgcgcgcctgtaatcccagctacaggggaagctgaggcaggagaattgcttaagcctgggaggcggaggtttggtgagctgagatcgtaccactgcactgcaatgtgggtgacaattgtttaaccaccaccaaaatgggttctgagtccaaatattaatatgaaggacattggtgacattgtctcaaaaaaattaatacagaaaagtacaaaaagggagagaaatcaccccaaatctcacgaccccaagaaataaacctcctaatattaagtgaacagcattccttgctgtgcacaaagatggctagagacatgaacagacacttctgatcacacaaaatgagattttaaaaacaagaagtagcaaattgaatgctgtgtaaatttatcagaagaaaaagaaatggaagtgaaacagaaggaactggtcaactcaggtaaatgtagtttttcctcactaaaaatcagtttctagaacatctaagaaatcaaagatgatgaaaaatattaagatgttttatatatatgtaaaagtcttcacagttgattgatcatctcatgaaaaatttgtacagtcactgcaaataaagtcattgcaaaatctttactccttttgctttttgccagcactgacattggcctttgcagtctcttgacttcattctgccctcgcattccttttgctgttttcttgaggtcatttcttctcatgccagctgtgtcttgcaagtctatgttcgagttcatttttctttgcataattcaaagaaccagatagcatgccaaagcccattgtttaaccaccaccaacacgggttctgagtccaactattaatatgaagatgacacctattgtggtcttgtacattttgttgcctttccggggtgaaggacattggtgaccatttgtttcctctggagtggtcgattggtcatgaacttcctggtccagatagttactgtgtcatttatcatggtggttgatcctcaggtagttagggaggaaaataagcaagaagttatatatttaaaaccacgtttcaattttagacctgattaattgacttaataaagggcattagcgcttctacttcctacagtccctccctttacctctggaaactagttatttctaggttattttatgttgttaaggttgaccaccttctctttctgttctgcaatcatagccctatttttaaatggattcacctctcataattagccttttgtcatggtcattcaattcacaagttgcttattttttaatttcttggctgactaaatttcattatgaagacttttttttaaaaaagagctcagaaatactgtactctttaagttcttcaacatgtgatcatgtcttttgcctattttgattgggcaataatttagctggctataaaattcttggattatactctatttcccttagaaattataggcacccatccactgacatttcattgtgctttcttttttttttttttttttttttttgtgagatggagtcttgctctgtcacccaggcttgagtgcagtggcgcgatctcggctcactgcaacctctgccgcccatgttcacaccattctccttcttcagcctcccgagtagctgggactacaggtgcccgcctctatgcctggctaacttttttgtatttttagtagggacggggtttcaccatgttagccaggatggtctcgatctcctgacctcgtgatccgccggccttggcctcccaaagtgctgggattacaggtgtgagccactgtatgagcccagcctcattgtgctttgtactaaccccctttccctggtctcttccagcttgtcttcttctctcccagtagtttcttcatgaagaggccatgtgctatattccatgagatatttcacactcaaagaagacttcttttatactcttttgataatttgtctgggaatcactgtcttgatttataagggagtttgtaataaatacagtaaaagagaaacacacaacgtattttgagacatcagagaagagagaaaccaattctattaatatttggggttagcagggaaggcttagttaagaggtaacatttgaactaagccttgaaataagggaaggatttggacatgcagtaatggggagagagtagaagcaagacatgatggttagtgttatgtatcaattggacttggttgtggggtgcccagatatttggctacacattattctgggtgtgtctctgagatattctggatgaggataacatttaattggtagactgaataaagcagattgtcctccccaatgtgggtgagcctcatccaatccactgaaggcctgaacaaaacaaaaaggtagagtcacagagaatttgctctttttacctgattatatttgagctgggacatcaatcttgtcctgactttagatgtggactcgagttggaactatatcattggctgtcctgggtccccagcttgctggctgcagacttcaggactccttagcctccataaccatgtgagccatcccttacaactaatcaatctgtctctctctatgtgtatagctctacctctatctctctgctctttctctggagaacctagaacaatacacaaggttatattagagaagaggatgacccaaggaaaagcatggaggcagaaaaatgcaaagagggtttgggaagactggggtcctgacggggagtttggatttcactgtgtgtagcatggagaatccttgaaaatattcaagaggtgaaaattgtatttgtggaagaacaccaggagtatgtgaaaagaaaaacactcactccattttaactccactgaaggaggcatcaaagggatgcactggggacatggggtggagggtagttgaggccatatctggaggatctttacttctaggctgagtctgaagttatctttctggggagtgggagattacaaatctttgagctccactcaagagatggttttgctaacaatggcagggtgacggtggtggtggtggtggtgggaaactggtagcatgaattctaattgggcttctgttattctagccgagaaagttggggaatggactttcggtagaataatacagacctgggaatcaactgcatggaggaggtagttataggtgatgagatggctcagggacaaagtttggtagaaggagaaaagatactaggctggtacaaaaataattgctgtttttgccattacttttaatggcaaaatccacagttacttttgcaccaacctaataggatgcaaacttcggagccatctgcatcagagggattgatgaagatcagcaaagtttgggaacacaggaaaggagcggggagggtaatgacttgagggcatagcagggataatcaaggtttttcttgttagcatgtggagacttaagcatgattatatgttaaatgcctggcacatacatggtgcaaaatatttatgagtgaaatgacaagtgaaggtggtgagtcacgggagttccaagggaacgggtgataaagggaggtctcaaatgaggcacaagtggagaaggtagcttgggaaaggagaaggatgcttctccttataacatgggaaaggcagaggaagagagtcaaggtacagtgatctaggggtgagatggaagtgagttgagagaactcaactctgggctctgaaacccctaggaatgggtttggggggctttgagatatggaagaggtttaaagttaattgttatagcaaatatggtttggaatttatttgtgatgcttaaaaatattgctgaacagaagtgaagtctaccctagagttggatggtgagattatttagtggaactaccagatccatgttgtgattctttctagtatcattcagcagcccttgggcaattgcgaggcaagtcatcaatggggtatggagattttccaggtgggtgtggttgaaggcagggaagaacaagtttaggagcacattacaagaagaaggtgactgtaaggtccaggctgagcaggaaggtaaagcaagaaggaaacatgaggttgtgaagagaagtttagagggatgaggaggcaggagagatgagagttgcaggatgtagctagagtggcgatgttagatcttggggccagagagctttacaatgagtatgaagatcaaagggcattagaatcaagctataaagagccactgtttgatgttgggatgttaggatgctgcaggtggatgtctgcacattgatggtgagaacatggtcaccctggccctgctgggtctttgctaaagagactgtgctctgttcttggggccgttttcatcacctgattagagcagtggttcccaaatggtgttctttggaccatctttataaaatgttcataggtcaaggataaaatggaaaaacagagaaaatgtcacagaaatgtgcccattggtgaaagaccaccagctgtcctttttggaggactgttctttattctaaaaatgtatatattctattctattaaaatatttttgtatttgcatttttttctcttttatgaaatgccatggggtagaaatttgtaatgtatccaattctcctgtcttcatgcgttgccctgtggtgggggaggggatgtggctagtactggccaagaggctgggggcagaggtgcagtgttagacttctagcctggagcatttaattcttagtacaagactctctagcattcttctccttctgttccctgcttggtgatactcgaggtaatgcagcccccattagccttagtcttagggcaagtttgatggaaaacagagcaccccacacctccctgcagatgtagcatgagtgagaaaaacaactactgatgtttgaagttaccaagatttaggagttgtttgttattgcagcaaaacctcacctattctgaccaatcatggtggaatttctgtgtgtgtgtgtgtgtgtgtgtgtgtgtgtgtgtgtgtgtgaaactggtagtttaaaaaagttccttcttaccaaaaagaaaaaaaagtagcaaccttatgttggttctcaaattaataaaatatttttactggtttataaaatagaaaaatctgagaatctgtagcttagagaactacagtgtgggatgtctataaggaccaggttattttatcagctcctaacaccccttaatagaagcttagccaagacttggactatttcagtctttcccattccacattccatggactcttgaagagacattgatgaaacggtgcagccatgaaccaccctcactcaatcctagtggcagaatctcccttttactgcagaatgagcttcttgctacagtgatacttgaaccccttagatatatcctgtactaattatattaaaacacgaccaatgcttttgctttgttgtcccccaaattaaacaccttaatcatgagaacccagagaattggatttagtgtgactgattccaaactgccagtaagaacacaattaggttatatttttctccagttcaaataaaagaaaattgacagtaaaatgctgatcaatatgtgtagctcaggaggtagagcctgctttgagatgcagaagtgtttgttttttttagatctatattcttgagtaaagaaaaaatccatctctctttcctagaggggaagactttcagagttgggcttggcaacagcctatcagaggctgaattaaacaaataggtacctcccttgagtgaatggtgcgtttctcctgttcagggaaccgtgcttttatggtggagtttgctttctgtcttggtctccggatgtgtgtatctgtgggtggatgtctgcatgtaaatggcagtgtatacctgtgtgggtgtgtacaaaattccatgtgaatctcagctttgtgggaatctccgggtcttgagcccagcagatgccatttgaagaaaaatcacttgaaaatgagacagaaagaatggaaactaaatcctagctctaaaggcaccagactgattaaaaacaaaactctggatcttctttgttttggactctacctacctccaaatgacatttctctttcctatgaaatgattagaatgagagatcctgagcatgaaagagcagatactgtgtgattgtgtgtatgtgagggtgtcagctgtgacactgctgacatttcggctcagcaatttctctgttgtatgtgtgggggttccctgtgcattttaggatgttgagcggcatccctggatccctggactcactggatgcagtaacacaactccccccaagtacagacaacccccagtgtctccagatattgcctaatgtccccagggggcaaaatagccccatctgagaactgctgctttcataaagtacaatgtcaggtgaaataggtggaggctgtttgtagtcagcagttagtagagatggaagagaccccaggaatatcctggaaggggctgtaatgttctgtttcttgaattgggtgtcggtaatatggagatgttcagtttttttgttttttttttgtttgtttgttttgtttttttggcaggatcttgctctgtcacccaggctggatcacagtggcaccatcatggctcactgcatcctctgcctcctgggctcaagcagccctcccacctcagccctcctgagtatctggaactacaggcatgtgccatcactgttgcctaatttttgtatttatttattttttgtagagaggggggtctcactatgttgcccaggctggtctcgagctcctgggctcaagcaatctgctcacctcggcctcctaaagtgctgggatgacaggcatgagccactgcacctggccagtatgttcagtttgtaagaaaagtactgtgttgacctcttctatgtgcacatttctttaagtaataattcaataaagcatttagaaaaattggtcataataggagtgatttgtagagtgattggcatgaaagctgatcaccttaatttgaactactctgaaatgagcacctggggccaccaagaggaacctttcaaggtgtcatagccaaggataggagtgtgttgtgtacatctctgcataaaggatttgctggttacgtggaaggatgaagcctccttctgaggacacaggcagcaaggcaagtggaagctcaaagcattgagctttctaaatggactttgctaaaatcttgtggatgactcatgctcttaacatacacctatgtacatattgtccatataaacattaattctgtaacaaggcccacacataagggtatttttttgttttgagacagtcttgctttattgcccaggctagagtacagtgacataatcgtgactcactgcaacctccacctcctgggttcaagcaatgcttgtgcctcagccccccgagtagctgggactacaggtgcacaccaccatgcctggctaatttttgtatttttagtagagacagggtttcaccatgttggccaggctggtctcaaactcctggcctcaagtgatctgcccacctcagcctcccaaagtgttgggattacaggtgtgagccactgtgtctgggcccacatgtaaggtttgagttgagatagagaaactctggcaggactgaggaatttggccacagtctctgggaaatatgcacaatttctggaatcttctctacttccagagttcccactttctatctgtctcctatttattcaacaaacttgtatggaaccacagtgtgtctagaacttgccaggcatggaggataaaagatgactgaggtcgggcatggtggctcacacctgtactcccagcactttgggaggccaaggcgggtggatcacttgaggtcaagagtttgagaccagcctggccaacatggtgaaaccctgtctctactaaaaatacaaaaattagccaggcatggtggcacgcacatgtagccccagctacttgggaagctgaggcaggagaatcgcttgaacccaggaggcagatgttgcagtgagctgagatcaccccactgcattccagcctgggagacagagagagattccatgtcaaaaaaaaaaaaagatgactgagatacagactccatcagagttgactctaacacaaatttggtaagagcccaaggtctggctgggcaagcaccttgatcggcctcatcctgcagcgtctactagaatgaagagcacttttttctttactcatgaaaatgttttgtgcttcgtacctacaagtacaatttgagttaattctgcaaaatttgccgcataactctgcctgtattcttagcatttttccttggagagatttctcagcacatcatctttggactatgtggaattggaaatttacttagagtcaacaacaagtacaggaaagtcagttcttagtcaagagttaggttttcaaagacagtggataaaataaaaaatctagtacagtcaagattatacgtgcaaatcccctcatcattcataaagtttagccgtcagtcttaccgtggctcaccaggtccaatccatacttcttcctccacgattggagcagagggtgattttttttatgagcaactgatgaagtcatttagagaccatttgcagtaggagccctgtgtactagagaccaattaatgtgccctcatggcaccatttctgcctctctccctctttgttcttgccaagtacccatagttcattttccatagattaaaagagcccaagctgggcctatacctaggagtacaattactgggtcatttggtaactctatgtagaattgtttgggaagttgttaaactgtttctcacagtggctacaccattttaattcctaccagcagtgtatgaaagttctagtttctctgcatcctcaccaacacttgttattttctgtatttttttttttttttgagacaaagtcttgctctgtcgcccaggctggagtgcagtggcacaatctcagctcactgcaacctctacctcccagattcaagttactctcctgcctcagcctcccgagtagctggtattatagtcacctgccaccatgcttggctaatttttgtatttttttagtagagacagggtttcaccatgttggccaggctggtctcaaactcctggcctcaggtgatccacctgcctcggtctcccaaagtgctgggattacaggcattagccaccacaccaggccaattttctctatcttcgattctagccatccttataggtatgaagtggtatcacattgtggttttgatttctgtttccctgatgatgagtttcattgaacatcttttcatgtgcttattggccacttgtatgtcttccttggagatgtgccatattttcatattcaaaaatgagagcacaggtccacacaaaaatttgtacgtgaataattaccacagcatcactgctaataacccacagagggaattaatccaaatgcccatcaccagatgaagagatacaccgattgttgtctacccacatggtggaatattatttgatcacaaaaaggaggaaagtacatacgctacagcgtggatgaaccttcaaaacagatgaaagatcacattctacatgatttcattcagatggaaatctatagaaataggaagtcgattagtggttgcttagagctggtaggggcatgggaggatagggggtgttagctaaagggtatgaggtttctttttgaagtcatgaaatgttctaaacttgactggtaatgtttgcgtatatctccgaatatattaaaaaccattgaaatgtaaaaagtgcaaagaaaaaacagcccaagttgcaattttattcaacacttgattggctttaaaaatagattccaggctgggcatggtggctcacacctgaaatcccagtgctttgggaggctgtggtgggaggattgcttgaggccaggagttccaggccagccttggcaacatggcaagaccctgtctgtacaaaaaaagaaaaaataaatatcagctgggtgcagtggctcacacctgtaatcccagcactttgggaggctgaggctggcagatcacctgacatcagttcaagaccagcttggccaacatggtgaaacctcttctctaccaaaaatataaaatttagccttttggtactctgagcagcaccatggcggttgttaagaacaagtgccttatggaaggtggcaaaaagggagttaagaagaaagtagttggtccattctctaagaaagatcagtatgatgtgaaagcacctgctatgttcaatataagaaatattggaaagacttcgtcaccaggacccaaggaacccaaattgcatctgatggtctcaagggtcttgtgtttgaaatgagtcttgctgatttgcagaatgatgaagttgcatttagaaaattcaagctgattactgaagatgttcagggcaaaaactgcctgactaacttctatggcatgggtcttacctgtgacaaaatatgttccaaggttgaaaaatgttcaacaatgattgaagctcatgttgatgtcaggactaccgatggttacttctttcttctgttttgtgttggttttactaaaaaacacaacaatctgataccgaagacctcttatgcttagcaccaacagtctgccaaatccagaagaggatgatggaaatcatgacctgagaggtgcagacaaatgacttgaaagaaatggttaataaattgattccagacaacattggaaaagatgtagaaaaggcttgccaatttatcctctccatgatgtcttcattagaaaagtaaaaatgctggagaaccctgggtttgacaggcatggaacttcgtggtgacggcagtagttctggaaaacccactagggacgagacacatgcgaaagttgaatgagctgatggatatgaaccactagtccaagaatctgtttaaagttcagacttaaaacattggcaaataagaagtcctatttgtgaaaaacaaacaagaaacaacaatgaaaaaagcaaaattagcctggtgtggtggtgcatgcctgtaatcctagctacttaggaagctgaggcatgagaatcacttgaacccaggagacagaggttgcagtgagccaagactgcaccattgcactccagcctgggcaacagagtgagactctctccaaaaagaaagaggaaaaaaaaagtatccaggctttgtggcatgcgcctgtagtctcagctactctgaaggctgaggtgggaggatagcttgaggccaggagtaatttgaggctgcagtgaactatgactgtgacactgcattccagcctggactgcagagcaagaccttgtctcttatacatacatacatacatacatacatgcatacatacacacacacacacacatgcacatacatacatacccaggctctacctcctgtgattctgactcagtagggtggggtataccctagggatcctgctgttcagcctggtctgggatccacttttcactgggaactgagacactggctgtgagcctttctgtcctgtgatgtagaggtcatggcgacacaggctgaagcttaaggagacctgactgtacgttaggtattgtgctgaacatcatctcttactctcacagcaacatccttagaaggttaatggtgtgtccccgctctacagatgaggaactgagctttcagaggagtttagcttgttcgaaacttattcttcctattggaaactttgtaccctttgagcagtgtctcctatcccctacgtttcctccaccccagcccctgataaccactgtcctactctctatttctgtgagttcaacttctttagattccacatataagtaaaatcatgcagtatctgtctttctgtgcctggcttatatcacttaacacaatgtctttcaagttcatctatgttgttgaaaatgacaggatttctttcttttttaagagttaatagtattccgttgtgtgtatatagtacatttgttttatcctttcatccactgatggacacttaggttgattctatatcttgggtattgtgaatagagctgcagtgaacataggaatgtagggatcccttcgaaatattgatttcgattttttttttgtctatacccagaagttgggttgctggattatatgctttgaaatctatagcacagcagcgtgactatagtcaataataatgtatctttcaaaataactaagaggctacatttcaaatgtctcatcataaaaattgtcagtaaattaggggatggacatgttaattagtttgatctaatcatcccacattgtatacacatatcaaaacatcacataaatgtgtacaattatgatttgtcaattaaaataatgttagttaaaaaaataagtaacttgttcaaagccccagttgggattgatggagccgggacatgcaccaaggcttttgctctcaggctcacagagtccttgggccacgaatgttgaagccctacctgagatttctactgagatcagtgtagggattcaatgtctcagaatcatcccatcctccagggcccacaagtccatgacctttgcctctacccccgaccctgctgacctgaaatgtggcccctgctttcatttctgggagcatacaacacttacaccaagcatttatgggttttattgacttcatttgagatgtggggccatggagagggtcccatgatccttgcttggtgttggccaactcattgaattctctctttgacttcacccttcccttttctactcacctcctctgtcatggattgctctgggaattctgagccctagttcctttattttgcagataaccttcactcttctctgcaacgaatcccaaaagtatgtagttgagctgactgcaaggtgcttgagatgccagagactccacaaatgggatttggcctctggaaagtggtggtagttccagatttatgtggatgttactttgtttttccctataaaatatattctttaaattatcaagctcttggctcctggatgcagtcctttgctggtggcagtgggctgggtactgtcaccggggagaaatgctgcccacttagagaaagagaaactggttctctttaagaggcagagggaggtttccagtgccagtttgtttggaggcaaaatggctgttgtattaaaattgcccaaacttgggctggtgccttgtgtgtttagagctcaaagccatgattgttttcattttctttttcttttttttttttttggtggtcggttttccaaccttttgcttggtaggtttctgctaatagcttcgacctcaagagtcccattatacagacactaatagtacctactatgtgtcagtctgtagtgcctactatgttccaggcattggagataatataatgatgaacaaataaacatggcacttggaaaagagagtctagttcccactctcagcccaccccaaagagaggcgagaatttggcttccaaagatctcagatgcccttgcatcgtctccatgaagagggcgggtgaagccttggtgtctgaagataatttggctggacaatccccaaggtttggaacgatgggaaggagctgccatctgtgtttaaggtgagaagcggggagtggctggatatcagaggaagccaagatgaagagaaggtttttgtgagctcctatgcatagtggagacctgttacagtgagggtccctggggctgagcctgtgggtcagtggaatgatgctgtgaggagggtcttgttatagcagatggcccaaaaaaggctgatggatcatgagcagctggaataatggagagtttggaggaagtagttcctacctggctttccaacagtgtgtaagcccagaattcttacataagcccatggagaagggaaaggaatgctggtaacgacaagattgaattctccacctgccaggcatccagggactcagagcagatttaactgaaattacagaaataggaatgtgacatttcctacatccgggtgcgctggagcaaatgtattccctctctggtttgtggggaaggagaatgctaacagacaagactccaggttttcgctcttaaacctggtgcctagaaatgcattttctactggatgcagacagaagctccatatagacatatccatcgctgcatctctcatgccttgtgttctccctaattttccctttttaaaccacagaggaagaaaattccagcatcacttctggcctctcaagagtgagttaggtggccaggtggggttattcatgcctgtaatctcataatgaagggatggcctgcccctccacacctgtgggtatttctagtcaggtgggatgagagacaaaaaagaaataagacacaaagtatagagaaacaacagtgagcccaggggaccggcgctcagcataccaaggacctgcactggcaccggtctctgagttccctcagtttttattgattattatcttcattacttcagcaaaaaggaacgtagtaagagggcagggtgataataaggagaaggtcagcaacaaacatgtgactaatagaatctatgtcataatgaagttcaagggaaggtactatgactggacgtgcacgtaagccagatttatgtttctctccactcaaacatctcagtggagtaaagaataacaaggcagcattgctgcaaacatgtctcacctcccaccatagggcggtttttctcccatctcagaattgaacaaatgtacaatcgggttttataccgagacattcagttcccaggggcaggcaggagacagtggccttcctctaactcaactgcaagaggctttccgctttgactagtccacctcagcacagaccctttatgggtgtcgggctgggggaccgtcaggtctttctcatcccacgaggccacttttcagactatcacatggggagaaaccttggacaatacccagctttcaaggacaggactccctgcggctttccacagtgcattgtgcccctggtttattgagactagagaatggggatgacttttaccaagtatattgcttgcaaacattttgttaacaaggcacgtcctgcacagccctacatcccttaaaccttgatttcatacaacacatgttttttgagctccaggttgggtcaaagtggttggggcaaagtggctggggcaaagctacagccaattcaagccagcaataaggaccttcaaaatgaccaaaatatgacttggtccttaccgttgcttttacaacctcaaaatcctgctcaggtcacctgcaaggcactcagattgttaatccatcaactgctcatagagatgactccaaaccacacaaacccaaactatctgcattttttaatcaattcagttaagccttatgggcaaaacttcagaattcaagtaaaacagaaggtctgtctgaacattttcttcagtcagctgaaattggatggaggtttcgttgtggtccctcaaggaataaaccattatttgaccctttctcttccaggtgaattcttacccattcctaaggtataagtcctgtgtcacctcctctcctgagaagctttttctgttgaccccacccaactgtcccttcagtctccttgtagtatttggaggatacaaatcagcacatatcatagtgaaatgtggttttacacatcagaatctcctgctatattgtgaggttcatggagacaaagacaatgtctcatttctttattgctgcatttctagccccaaacacagcatctgatatcatacaatagacatccaaccaggatttgaagaatgacttactgaattatattaataaatataaccttttcatctaggtgttagattaggaagggaatggtagatatcatgccttttgccaagttgattaaatattaattggaaagtactgcacgtcacatgagctttaatcaaaagacaatctacatttgtaacatctaactttgacttaattaggttgataactacatatgctattcaggacagtaaaaagacatgagaaaatgagaagaactatggatctagaatgaaagggcgtgtatttgagtcctagttctgcttccagcctgttgtgtgagctaagacaaaagcacaagatcacaagatgccatgaatcacaattttcaccatttataaatgtgaatctagataatactgactctagtcatctcataggattgttgtattgaatgtataagatgctgtattggaaataattcacaaagtatatggattgaacaaatgaggtgttttatacttagcaatagataacaagaaaagcataggttctggcatcagatagacagttttggacacatctccaaccctctccaaccttaacaagtcacttactctctctgagtttctacttttgcatctatagaacgaaagtattaacacatactagcagggttgtgatgaagattaaatgtgataatacatacaaaatgcctaatgcagggcttcacacacagtagatgctaaataaatgtctgttttcctccgttcttcctagtctatttgtatttttagcttcaatgtgtggtgtttaagcttcatctggaaaatgcgatcctaaaatatctactgtactatattgcaatatatagtgctatcagttgtgaataattggttgttgtgtttattagaaaatagttgatatatacaaaacaaatgttcttgataaaagcagagacatcaaggaaaattttattttttaacaaaactaaaaataaacccactcggcatgactactatttaaaaaaaaaaaaaaggaaaatagcaagtgttggcaaggatgtggagaaattggaacctttgtccactgttggtgggaatgtaaaatggtgtagctgctgtggaaaacagtatttctaattcaaatattaagctctataatgtttaaaaattggtctctcatctactcacagtatttgcttaaagctataaataatagctatgatttaatggaaagactaacaccactaaaaggttttcaaatgcttggctattttatgacaaatgggaataataataataacatatatacatatatacacataataataatatgtatatatgttattattatatttatatatgttattacatatatatatatagagagagagaggaaactaagaatgtttagccctgtgtctggcatatataaaactgtcaacaaatgttagatgtttttgttactataaagttatgtaaatattttttgtgaccttagaaaatctgactttgttccataagtaaggttttgctgtgtaaccaatgcgtaagttattatttaaccacacattcataacatatatattttttaaatatctagaatttgggagtctgacagattgcattttccaaagccagaaaacaatatctcccattccacatgctctgtgaccatgcccctcctccatgctggggaggagtcaaagtctcctcctcttgaatctggtctggacttagtgactggcttgcaaccaacagcatgagaaagccatgttacagcctgacttctgaggctgggtcatgagccttgcagcttcagccttggcctcttggagcactcactctcaggacagaccctccctgctggagtacttcctgtcggttccagctccacctgtccttgtgcagttccagctaagacgccagagcagcagacatgtgagaaggggcagtgggtcctccaactcctgcttctagagcccagacggtctagtctgagactagtcaacccagctgagaccccaggcatggaagaaagaggcccctcttttgcttctttttcagtgtccctacccacggagtctgtgaacataataaaatgattattttacacaactaagttgtgagagctgtgggggacagtgggactgtaagttatgggtaactggaacaatgatttagttatttgttcttgtacactttcaacttgaacttccaaatttatgggccccattctgaaactggtctacatctgcacagagatgtctctgctgttgagtagaccaatctgaccagcttttcaagccaacaacattaaaagccattcagaggacaacacattgtgaagtcgccttctcttgtgagaaatgcattaaaaagaaactaagacctactagagttgttctgtcaaatacaggggctattgagcacttgaaatgtgtctggtccaaactgagatgtgccttcagtgtaaagtaacatttagaagatagtgtatagaaagagtaagatgtcttattaatttttatattaattactaatgaaatgataatattttagatatattgagataaataaaatatattattaaaattaacttcacctgtttctttttactttctttaagatagctgctataaaatttaaaattataaatgtcacttgcactatatttctagccctgtactaaagggtctttacaaaatatcttggttttataatgttggcacagtaaagaagggggacaaaaccatctttcactccagacagacaagaatttgctttatcctgtttgtctgaaattggagtcaatggtcctaatgggtgggatagaccttatgtcattctcctaacattgactgggctcattgaaccacagaccaggcagaaaaaataaaataacacttaaaggacattttaaaacataataaaaatgggaaggaatattttcattatttctaaataaaatagcaaaaatccatcaatcatgttcctgaatgaatttctaacacctaagactgtgcttactgaggaaaaataaatagaaaagttgagcaattatcttgtaaacgtaaagaaatgtgactccatctcaaaacaaaaaacaaaaaaacaagaaatagatgagcttacatgggtctcagcagctacattttcctctgatttctgcttattttccaacaccctaaatgttcagaataataaaacaatgtgccactctaagtggagcaatgacaacatagataccaatggttcagaaagcatggtcaaagggcccctcgtgtttccaagatccttttgggagggtcacaaagttaaagttatttttccaattacaccaaaatgtctttttttttttttttcattcttattctctcccaagttgtggtaaagttatcaagaagccacatggcaagtgacatcaccacagactgaatacagagacagattggaaatccagctgccttccagtaagctaaatatgctaaacaatgctactttctcactaatattttttgtttgggaaaatacagttatttttcataaagaaatatgtcatgaatgttaactttagtgagtttattgttgttattttgaaataagataaacaatttttaatattcttagttctaatttctaatttggtaaataataatacatggaaaccacataaacaaaagctcttcaaggttcccaataatcttttaagagtgtaaaggttgagaggtgcaggaaattgagagattttggttaaaaggtacaatctttcagttataagtgagtaagttcaggagttctaatgtacaagatggtaattatagttaatagcactatataatatactagaaatttgctaaaagagtagatgttaaatgttctcgccacatacaaaaaaatggtaactatatgaggtgatggacatattaactgacttgattctagtatcatttcacaatgtatacatatatatcaactcattatattgtacatctcaaattatacaattctatttgtcaattataccccaataaagttggggtggggggaagaatataatgttatccttaggccaaaatgtttgagaaccagtggtatatacatgaatcaaccttaaaataggcaccagtggggcaaagtggttttccataatttaaaattaactaaaaaccatgggatttaaaaatccttctggcatttgtattatgtaataaagatggtccctatcacatcccagtcccctagctcacaattctctctataatatacattttctccacagacaatgacatgactaatagataacttctgtttgcccagcatatccccaggggtgtgtccagagttatgtgcaagccattggtggctaactataactcccacattctcagccacatagggaagcatctgaatgacctgtagtaagaatagtcttagattctcttcagttattttgttaaccatttacaaatatagatagcttagtaatagtaacaaattgtctgcaatttagctcatgattaacaactactttgacatccctgcacactagacacagaccacattttcagttagttcaaattcactgattaaaaaataaaacagccataatgaatcattaatgcattccagaaactgtatctttaaaaagcagatctgcctggcatttattataataaatgtctattttatatatacatttttgacctactttaagtggcatagatgagaaaaactttcatgacttaggtgcaattaaatattgctaacatttgatccattttgccatgttcttttaaagtaaagaaataacattcagtacttacatatctgccttcctcaccaggatgaccgggtaacccatcaaaacccttctctccctgagaagacaagaaatcaaaataaataacttggcctctaaattatttatttctcaaatctatatgaaataaaaattattactaatagatacccttgtctcacggagttgtcattttatggagaatgtactgaatatcaggcacaatgtgcagagatgtacagaaacaaatattcttgtccagtgttacagtgaaaacatgcatacctgtttgtcttaatagtatatcaaactattcttattttccaaaataccttcttaagtcattctcttgtaaaaatccaaatcaagactagtttctagttaaaagcttaaggaaaactgttactcttaaagaagctttcaaccttgttttacaaaacatcagtaagcaaagctcttcctgcctatcttattcatgagaaatggttgtttatttctgtatgactcaactgtccagttttgttttgtccttttactacttcttacacaccgaaacacacaaaccatttcctctcaaggaagtttggcttgccatgttatagtcagatgtgtttatttagtctaaaagctggtcagtaagacttggaaggcatattttatttgtgatcaacaaagatataaaagtcattatgaccatctactgaattcttgcaaacagaaacagcagagaagtcaaaaatttaaaatactcccatctttggccttagaggcaccggcacaagctgcaaagaaacgtatcaagaagctcctaaacctgattttctgattctccaatctgttaatgaataacaacatgacagggaaaagtctaatgctaaggcatgattacaatttatttttcaaacagtaattataaactttatactattctaaatttaaaagattgatctgcaaagccctgaagagctcattccaacaacctcatggaaaatcttccaaagagaacatgtaaaaagatgacacaaagccagcgggtgtaatttaaccttacctgtgtgtctgtgattataccctcattataaagcttcaatccctgtgataatggaaccttgccagccctgaatatctgaggaccatttctaatgagatactctcccttagaagtgttaggtagtaattttcctattggttaacctagaattaacagagatgcaactcttttctcagagtttgatgctgtagaaaagaatgttagatgggagagaggcatttactactataaagaaagcagatgttggacaagtgaaaatacggtagataagtgaaaacttctgtgcagtggcagaatttgtgacattatttgtcaaatgagcacaagaaggtagcataatatggtggaaatcatgtgggacttagagttagggagacataggggcttaactcccaaatgcatcttcataatgatgcaattttgggaaagtgatgtcacctctctgagcctcaatttcacacatgtaaaataacatctacagaaagtgtttgttaggggggtaaaattagaaaatgctgttaaatacataacacagtctggtatgtagcgggtactgaaatatcgtctctctccttccccctatccacacctgacaaattcttaccttcctcccagaactcccataatcacctctgtacccatcttctccaaaacactttgcatatatattgcagcatgttctttccacaattgtatcctgaaaaacagatccatatcacatacgattttctcatctgtgttagtctatatcacattacacactaagaagacaaaattctctcaatgtttttaaaattattataattaatagaactcagcaaaggatggcatttttaaaaagtacttacaagttgcttcagtaagacgcttgggagggatcgcagtttgatgctcagaggttgcttatatgcaaaccctctgccaaattccagctcctggagctcttctaatttatggacaacttccaggccaatgattaggagtccagagaatccttcacaatttcaacaggtgggagattactttcatgtcttttgaatggtctttgtctcagccccacatattcatccatcattccaccattaccatagccttcacctgtcttgtctcaaactgcattttgttacaattaaaactagtttgtggcatgccttcttgaagaatttgtctgatacctttcaatcccaccagctgaaagttgaacagaaccacaaaggactctcatagctctcttatagcccccattttgtcatttcacagacggttttcagccctcgttgtattaaattagatccttctaagcctatccctgaagttgacttttggtttacacttaggaattgtggcagtcactgtggctgttcacagatgttctggctccccttcttaagggcacatgataggatcgcatgtcttcagtcaggttataaacactcattgaggctcaattccttacctgtaaagtattatctatctcatgaaagttagaagtgaccatatggcttgctctagctaattaaatgtgagcagaagtgacatgtgttaatccccaggagaaattttaagagtagtgcacaatttgccccatttcctttcccttgccacagcaattacaaaaacagctgttgggatagaccctccttcagcctgggttcttgaatggtgagcaggaggcaaagatgaatcacttcttgctactttaagtcactgaggtttggaggttgttattgctgcataatctagcctatcctaccaacgcaggcattaagagatcatctggatttgtccacagaacaaaaatacaaatgaacaagggtattttggtaattcaactagaaatcaccttgtttgtcgaatttcaaaacaaatattactgttaatagtttgaacagtaaattcttggcacatacatgccaatcagctttttgctatggtaaacaagctgcttgagaactgtgtggttaaaagttgtgtacatattcttaattattccttaaaactaaattctttgaaatggaatttctgatctagcatagcatgtaagccaagtttagtctcttgttacatactctcaaatcccctccagaaaacatgcaagaatttaaacttccagtggcgatctatgtagtgaattaagatgggagtaaggtgtcataaaaagatattctagcacatgattaaccaatggaaaacattgtccccagcaaaatatgttgaatagactcgactgaagaggaaaagaggtgaaaggaacttgagcaagtcaagttgctggttgtgcatcctcaggttgcttttgagcctttacatggcacaaagtgggaatggtgagagtcatagtgtacagttgaacaagttgtgctgcacaagaacacccatctgagagagctaatgcacggccaaatccagccagcatacccctcaccacccaggagcccaatacacttgcatccatgcagtgtattggatgtccttctctaattgcacaaagatgccatatagactagcagcaggagcttttgaagatggagaaggaggaagaattaagagcaaagagggcagaattacaatgcaaagagcagagcccagctttagactgactccagagtttaggagaaaacgacatatggaccccagattgggctaaaagaacaaacagcccctctcaccatttaagtaggagttgtaccttcaacctccaaccctcaaaagctagtcctgtctgagtcagaagaccccggtcagtgtcagggacattgttgaagaaggcagggagtttcagccccaaaacatcctctggctcatacaaagaatgagactgggcatcagcctcatgagcactgagccccacgcactgggtgaacacacaggaagcttcatagagtccagtgccatctggagagctgagtgcctcagttccagtgggaggagggagggaggcccacactgggcaaccctatgcacttacctctgctgtggagaaactccgatgtttttttcagtctttttaaatcatcatccagtccatctgtaaacactaaaaggacctgttgtttatgagaaagggggttggcagaaccagacagggagggagggagaaaagagaagtaggaaggagggagggtggggaaggaagagaaaaggaaggtgataagacagtgagagcggggaggaaaagggaaaggagggaagaggagggaagggaaggaggaaagggaaggaggcaggaagaagggagggaacagaggggaaggggagaaggaatgcataaaatggatattataaattgtacatttccttaaaattcaagagtgagtttttctggttatgcctagcctttcaccctgttcctttttacttattcttttattacgcattcatctttatttcaacttccccatccccctgggaaaaaaaaagaggatttgaatcggctgaacttatttaaaaataccttccaaaaatgcttataatatttatccttatcaacaaaaaataccaaaatattaacagagaggtgtgtgtgcatgtgtggtgtatgcagtgtgggcagggatggaggggaggagatgtgggggtggttgttgctaatttctgttatactttgtaatgtattttctacaattgaaatgtgtttatttgctcataagaaatttttaatttaaaacaggaataaaaaataaaacatggatgatattagtcaaaaaatacatccattggatgcataacaacgtaaatgtaagttatgaagtttggggatgtcatttcctattatgtgatgtgataaacatcacttaaaagctttccatctctgtgggcttttgtgagtatatagttcagagacagcagaagggagggagaggcttgaggggtgagctgtactaaatagctctcactaaagacagttcaagatgctgactggaaaaatagcaagcctactctaaatggtaatgagtgaccataaaaagctaaggagtcttaaaacaccttccaagttgtcttggaaatgaatttatgttatggaagaatatgaatcactaaactgtgggcaatttgagagcagggactttattcttatattcctactagcattattgagcatagaacatctagggcttaaaaaatatttgttgttgaatgaaaacacatctcttgttggttttattgtgtaacaggatggctttcctctgtgtaagatcaccaattaagaacaatttagttggcctcagtcacaaagccttatccattctaccctacctgatggctccatagcaagggttctcagcatttattacctttacattagcagaagagagatgaatagcattatctcccaaggactgcaaaaagttcacatccatattgttattcctggcagcctgatgaaccaagaacttctggatgatctcataactgtatttttcaaagcctgagtcaaaggtaagctggccatttgagccaggcaccaagtagcggaatcttgggtcgatctgatcagaaatgccacggctgatgttagaaagtaaagccaactgttgcatcagctctggcagtaacccttgaagcttctgctgaattttctttgaaggagttgagatatcaattcctacagacaaatccaggttgcatcctttgaaggtgaagaaaataaaattagtcatctgcaggtgcataactaagcccagaagatatcagccaatccagccctaaaagacaaacccccagccaacccacagaagcataagctaaatagtggtagtttaagttttgggattgtttgttacacagcaaaagctaattgatacaatacatcctgtttcatagctttatgcctctgcagatcctactccctttgcctaaagtgtcttttcccatcttcccaccccagtctggtccttcaagtagtagttcaagtgcctgccccaccccaccccactcaccaagcactctctggtttttgtcctcacctcctcatgttaagttattaaatgcccgtgcatgctcattgttactttatttgaccttcttcctgactaaacaaggattccttgatggtaatgactatgccgtctaattttccaattgcctaatacagatgttcattaaatgtttgacaaatcaatgaagaaaaggatataaatgagccttaagtctctttcaacaataactggaattatttccttcttccctgatagtgtttttcctcattcaccacccatgcctataccttgtttcagcagcatgggagcatattagaaaatgtcaggaaaaaatcactcccaattatctgtttcttatatctaaaaatagttaagccctcttgggtagcttttctctggaatttgaaggccaattaatatttcaggctatacctatacacttaccagtatataataaaattttgcacaaaattccactaaggatcaaaagttgatggtcagagacacatctgagttggaatctggttggatgaattaaaatgtaacaaccttaaaagggcacctattaattacttctgcacaacaagcataacttaggactgtccaaggcaatccaggacatgccaacattttctccttagatcatcacacactagagtatatgatgatgtaaggatctgtgtctataacagaatctatatacctgtatcagaatctgcaagaacagaactgcaaatggggaggaacaatttgagggaaaataaatatgtagtagaccattcaccatggacagtagcttaaagtttcccaaaaacctgagatcagagctgagccatgagcattcagtcccctaaatgtcatactccatgctagctggtaagatatatttctggaactgccaagacagaaaatgccttcatctcctcctttcacataaaatatcttagtttggtttggttttttaaatatgtaattcaaatttataaaaatgagccttcacagatgtaaatcccatttctatattggacctaatttcagaaaaaaaggaatttcctttttgtagtatggcatattattccaacatttctaattcacattttcaccaggaacatttccagctggctctgttctataattgacaaatgcaagaagcaatttctttcccttttaatggagaggattaaatcttgccaggtaatctctaaggtctttttcaggtttatgattctagaattctataattaattagagtctagcccttattaaagtgtctagctaatttcatcaaaaaatttaaagacaaagttgaagataaacataaatcctaacttactataaggggcaaaataaactgaaaaaagaagctgaatcctatatctcctcttctccccagtgtaatacctacctgcgtataaacaaaaaataggactttggtgactaaaaaactctgaactacttaatgtaggacatgccataattcatgcttcttttaaaaataattgtacatgtgcattcttttcagatgattttcaaatttggctagactactgcaaagtagttatatttttttgtcaatataagcaaagatattaatttaatgtcctagaaaattggacttcaaagttttggtggaatgcagggttctcatcctagtcctccaaaattaagtctctgtttccaaaataagacctagcccaggccagtcacagtggctcaaacctgttatcccaacactttgagaggacaaagaggaaggattgtttgagtctaggagttcaagaccagcctggataacactgggagactctgtgtctacataaacttaaaaaaaaaaaaaaaacgagccgatgtccactcgcctgtggtcccagctagaggtgaaaggatcgcttgagcctgggagtttgaggctgcagtgagctgtgatcataccactgcactccagcctgggtgacagagtgaaatcctgtctaaaaatttaaaaacaaaacaaaacaaacaaacaaaaatcttgacccaagtatggccctagtttctcatagagaggcttcataggcatacataatgcttagtggttggacttttgacaccaaactgctggggaattcaaactcagcctctattacttcctgtctatgtttcttaacctctcccttcttgttttttttttttcagtctggaaattgagtatcataatgatagcacgtgcttcacatgggtttgatgtgaatgttagatgaatgtataccatctaacacattagaaatagtgctttgcattcaaccttgagttttaaaaaaaaggaaaaaaatagtgctacatacataatggaaaaaaacaagtaagaatctagactgtgccccacctggagcctgccctgcctttagaatgccagttagatggaataaaatgtgtccttcttacttgagttttctattacttgtaggcaaaaacatcctacctgataagaggatttttcttaatactgcttgttatctcagacttgttgtgagaaatcaagtaaaataaaggatgagaaagtgctctataaatgtcaagagcccatattctgcctcccagcagaaggctgaaggtggcaggacctcatcaagaggcacacagttaagtaagaacatagaggtgagtagcctcttcttttcagcctaaaactacaaaaaaaaaaaaaaaaaccttctagatccaattaaatgcacatctatttagggacataataacaaaatgatttcctgtattcacatgatcacttgaaggaattttgagttttatgggttccattatatatcctttgacataattccttgctatgctcgaagttataccattctatcacattctgtgctatcctgtactataccataccatacatattgtatttcactatactatgctttattgtgcttcattgtactgtactatactataccacactacactatcctatcctatcctaccctaccctaccctaccctaccctaccctaccctatcctatcctatcctatcctttcctatcctatcctactactcaatgtatgatgaggcctgcaaaatctgcgtcacctgggagcttgttagaaatccagaatgccgatctgctgaattcagaatctgcattttaacaagatccctagatgattcaaatgtatgcttaagtttgggagcccttcaatcacccactgaaaggcaagtcttggggaagaaaagcggaccccaactgtcaaaaggaacaacccctgtctttgcgccttgcagctttggataaaaacttgaggagacggaatgggattaaggatgaccttggccatatggaagaagattggcaacaaagtaggcagacccctgtacagagcctcatggagaagacactgtattctatttcataagagagactgtctaactgacattattctctgcttctatttccctcttgacatggccaaaccttcagcacgttgtgtttacacattccaatctggttttgcctatgctataaggaattaaaggaggagttgtgaggacttcctagagacagagttctaagaagcttcaggccttcagaaaccaaagtgatgacaaccatgggaatgattaaaagaatccccaggggagggtgaacaacagtgtcaggagttcaggccctacagggtgatctcctgctccccttcttgcctagttagaaggatcagagttttactttattaagagaaccaacaggatctctaacacctatgatgagcttgtggatcaaataacaattctctgtcactcaccttgtggatcacagaccttagaaagaatttccttctccaggttctgcagggcctcaaaatttacatcatggtacactttgtcctcatcattagttatctccaaaagctgcgattttttggcttctcccaccccaatggcaaaaataattgtgtttttgtccctgagggctttggctggtatgattacattatcttgggccaccccatcggtgatcacaatcaaatattgttgaacactgggtctccctccttttgaactgtcaaaaaaaggcagagtgaaattcagagctttcccagtgcgggtgccatccctcatctgctgaacatcaaagatggccctgtaaatgtccacctttgaggattattggttgagcctgaattcttcctgggggattgagctgaactgcaaaaggccaatttgttttttttttgttttttttttttttaatttttattttttttattgatcattcttgggtgtttctcgcagagggggatttggcagggtcataggacaatagtggagggaaggtcggcagataaacaagtgaacaaaagtctctggttttcctaggcagaggaccctgcggccttccgcagtgtttgtgtccctgggtacttgagattagggagtggtgatgactcttaacgagcatgctgccttcaagcatctgtttaacaaagcacaacttgcaccgcccttaatccatttaaccctgagtggacacagcacatgtttcagagagcacagggttgggggtaaggtcaccgatcaacaggatcccaaggcagaagaatttatcttagtacagaacaaaatgaaaagtctcccatgtctacctctttctacacagacacggcaaccatccgatttctcaatcttttccccaactttcccccctttctattccacaaaaccgccattgtcatcatggcccattctcaatgagctgttgggtacacctcccagacggggtggtggccgggcagaggggctcctcacttcccagtaggggcggccgggcagaggcgcccctcacctcccggacggggcggctggccgggcagggggctgacccccccacctccctcccggacagggcgactggccaggcggggggctgacccccccacctccctcccggacggggcggctggccgggcggggggctgacccccccacctccctgcccgggcggggggctgaccccccacctccctcccagatggggcggctggccgggcggggggctgacccccccacctccctcctggacggggcggctggccgggcagaggggctcctcacttcccagtaggggcggccgggcagaggcgcccctcacctcccggacggggtggctggccgggtggggggctgacccccccacctctctccaggacggggcggctggccgggcggggggctgacccccccacctccctcccggacggggcggctggccgggcggggtgctgaccccccaacctctctccaggacggggcggctggccgggcggcgggctgagccccccacctccctcctggacggggtggctggcccggcagaggggctcctcacttcccagtaggggcggctgggcagaggcgcccctcacctccggacggggcggctggccgtagtggggctgacccccccacctccctcccggacggggcggctgccgggcggagacgctcctcacttcccagacggggtggctgccgggcagaggggctcctcacttctcagacggggtggttgctgggtggaggggctcctcacttctcagacggggcggttgctgggcggagggtctcctcacttctcagacggggcggctgggcagagacgctcctcacctcccagacggggtcgcagccgggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcagccaggcagaggggctcctcacgtcccagacgatgggcggccaggcagagacgctcctcacttcctagacggggtggcggccgggcagaggctgcaatctcggcacttcgggaggccaaggcaggcggctgggagatggaggttgtagcgagctgagatcacaccattgcactccagcctgggcaccattgagcactgagtgaaccagactctgtctgcaatcccggcacctcgggaggccgaggctggcggatcactagcggttaggagctggagaccagccctgccaacacagcgaaaccccgtctccaccaaaaaagtacgaaaaccagtcaggcgtggtggcgtgcgcctgcaaccgcaggcactcggcaggctgaggcaggagaatcaggcagggaggttgcagtgagccgagatggcagcagtacagtccagcttcggctcggcatcagagggagaccgtggaaagagagggagagggagaccgagagggagaggggagaggggagaagggagagggaagagggaagaggggagaggggagaggggagaggggagaggggagagggagagggagaggcagggctggtcttaaagggagaagagcatgctcccaaaaggccaatttgaattccatcagtaccaatattagattggttcaccatgctctccacaaatcttttcatcttttcaaagtcttttggggagatagattctgaaccatctatcaggaagataatgtcagctttactattcttacaggctggggaaaaaggaaacagaacagaacattcattagaaatctgaaaccaaaaaaaaacaaaaaacaaaaaaagaatctgaagccaattaattacaagtccccagggacagtctggaatggcatatatacaacatgaaaatattttagaagggagtggaagaggaattcaatgaaacaaatattctgcaacccagcagagttgctctgcaattcagagtagtctcaaaataagatacagctgtatgataaatatataaaacttgaccatcttgcttcattctaggttgtggtcactttgagtgtccgatactaagctgccaaccagtgaatccatgattaaagaatgaagctggctaggtgtggtggcccacacctataatcctagcactttgggaggctgaggcagaaggattgcttgagcccaggagttcaagaccagcctggacaacacagcaagatccagtcttggggaaaaaatgcgtaaaagaatgaagcttacttaaataaatcaggtacatattcttggagaggtgggaaaggagattgaaaaagaaaaagtcttaccctctgaggagcagatgtcctgtaccacttctttttggatgtccttcagtaaatcaaactcatacacaaaaaatatcttgtctttagctatttccttaagctcatcaatgttagcttctcttattccaatggcataaatgttaactccatttgccctcaatccctctgcagcctcagccaccgagtctgaagatttaccatcagtgatgactataacatatcgagcaacattgattcggccggtgtctgcaaaaacctgagtcatgttgttcaaggcctcaccggttttggtgccacctcccccctgctggatgttatcaatggctaccttcagctctgtcacactgggatactggctgaggataaatttacttttaattttgtctgagtactgaatgattccaaactgtactctgttgggcccgatctggaacatctttatcacttcattcatgaacaccttcatctcaagaaaatcttctggatagatgctgccagacccatcaataaggaagtaaatatctgccttttcgatgtgcacacaacctaggcaataaaaagaagcaagaacccatcataacagagtctgagatggtgaagaaccagagcgattgatcccaatctccaaccgtattctctcagtactctttgttcccttgacagcacctgtgactctgcctacaggcactctttggccaagagcatgatcagctggcacactaggaagaccagaatgcctgggagtgagtccagaagcagccaccacccaataactggcagaggttggtggataaagaccccagctcccttgttcattgcatagaaccactctaaggtaagtcctgcatggtttccctgagtccccagttgcctgtagcagtaacctgtagattactcctcatcccgaattggttcttaaatctccactctcctataagcatcccctggcatcaccacccagataaataatttgcatccaaatcattgtctcagagtctgtttctgatcaaccccacttaagacacgaaggaaatgtaacttgacatttctcaaatggggaagttaaggaaatgaaagtaaaatcagagcacatttgaagctatgaattgtttcatattccattatccctgcctcccatccaagttgtgctttttaagtacatgggcaaaagtgtgtacatcctaaaatttaatttaatttaataatttgacaagttaatttaaaacattctctattaaatgagcctgaattaggaaacaacagatgctagtgaggctgtggagaaataggaacgcttttatactgttggtgggaatgtaaataagttcaataactgtggaagacggtatggcaattcctcaaggatctagaaccagaaatgccatttgacccagcaatcccattactgagtatatacccaaaggaatgtaaattattctactataaagacacatgcacatatctgtttattgccatattatttacaatagcaatgacatggaaccaaccaaaatgcccatcaatgatagactggataaagaaaatgtggtacatatataccgtggaatactatgcagccataaaaaggaatgagataatgtcctttgcagggacatggatgaagctggaagccatcattctcagcaaactaacacagtagcagaaaaccaaacaccgcatgttctcattcataagtgggagttgaacattgagaatagatggacactgagagggaaacagcacacaccagggcctgtcggggggtggtgggttgaggggagggaacttagaggacaagtcaataggtgcagcaaaccaccatggcacacgtatacctacgtaacaaacctgcacgttctgcacatgtatcccatttttttttagaagaaattgttttaaaaaagagtctgaattaaatcagtcaccttgtgttaaagcccagcctccagggcaagtggctctaaatttaatcctgtctcctcggttactagcaagcttggcccccttgcatctcagtttcctgatctataaaatgaggatgttgacacctactcagtaagcttattgtgagaagacagtaatatcatgtaaacagagcagagctcagtattaaagatgtagagttaaaagtagctggtgttttattatttttgtcatctagcagattcctctaaaaaatatatgtatatattttctccactccctctcaataagggcagcccagccttgagttgttaatctctggattcccttggccccaggaagagccttttcatttctcggctgaaagggaagttgtctaaggtgggaattgggctccctgctcaggtcttcatgtgggaggacctaggtccatgcaatatgtgtggcatacttaaaaaacccttgttgtttatatgaatgaaattcaaatgtaattgggtgtcctatatttcatctggcaatgctatcctaaaggggcattcattggaaaggaatgtagcttaaagcgggtagagaaaggagtcatttaccccatggtaagtgtttgctgaattctggagagtaggggcgaaattatggaaaaataaggcaaaaacccaaactttgctggactccagcatccactggtgacacatacatggctacccagcgtcagagaaaaggaccaccgtgcaggaaagggcatctctgcagctagcccctataggagcagcccaaggaggcttcactataatccagggcccttggattgtcaagaggagccgaggaccctaaatattgcctgcactgtacattcttgtcagtcttagcagattgggggaaaagagaaagagaatatttcttacagtctggaggttgccgagcattcacatcaatcatacacataaagtgcttagcagagtatctgacacatggcaaatggccagtaaatagtagatattatgatcattgtgatcatccaagacaaaattctggtaaaatcatcatagcttctatttacctctaggctactcccttccccaacccatctagactttgggctactttttctgattgcaagtttctttttagcttctctgcagtatcaaaaaacaacaacaacaacaactctcagctcttcatattgtgaactagtagtgctcgtcttctgtccttctcatccacagaatataggcagataggcacacggaaatgaaattcacattataacaattttgtatctcattcctagaactgagaaaggaactaaaaatataggtcaaagagaaagatagaaatttatttagatatttcagatttctagacctcagcacaagtaatcaagaaattaccagatcactcagtgtttaacaagaaaaaaagctcagtgattttcccttgaaaacataattacagccttgaatttttacctcaattatgtacatttcaacgattctaatttaaatctatgattctaatttgaatctaagaaatactagcatgggtagacaaaaatagattagaagacagacagacacaaagattttcataacagccagtaagtgccaaatctaggatttaaaatttgggcattcatatgccaaagtgcacacacttaaccactatgttttttctggtgtgtgtgtttttttgtttaactgggtatgtagtaggaactctcctgaccaacctccactttagtgactcccagataaatcaatgttctcccttccctctgtaaagcatgagtgatgctcccataaaacaatgagtgcctgaagttccgcttcaaccagtgaaagaacaagcttaccaagatgaaggcgggtttgtccccagcttgtttatggcagttttgttgttataattacataattaatcaaatattgtgcaaatcagcaggatttgagtgtgagtaaaagagatttattgcatctatgaaaaccagcttaactgctttaaagactcaataaaagagttattttttaaaaaattgccagtgtactagatagcattacaaaagattgcatttttaagattataaaaatcaatagctatttctgtttctgttttgaattgtttcaaaagtcactctcctttaaagaaactgaaactggaaattattgataacataacattggatggtttataaagaaaatacatgaaatccaatcagcagggctcatactcaaagaagccttggccctataccaaaagattggcaaattaacattcatttatatgtattaagttaattttttaaatttcatgtgagaaacaatagtttctgagaagaaaataaataaataagaaaataacattttaaaaattcaagtatgtttgtatcctttttaaagtagttgcctgcttcagtgacttaagatttgatcagtccacactcggttccttagggcttctactgtaaatatacacaactcttcatcaaactgttaaaacagaagggggccagacatggtggctcacacctgtaatcccagagctttgggaggccaagtatcaaggatcacttcaggccagaaattcgagacctgcctgggcaacataatgagaccctgtctctgcaaaaaagattataaaattagctgggcatgggagtgcatgcctgtagtctcagctacttaggacggtgaggctggaggatcacttaaccccagaagttcaaggttacagtgagctatgattgtgccactgcactccagtctgagtgacagtgcaagatcaaaatttacataatttttaaaagggatgaaggataagatgggaggtgctagaaatgttgcctttttacttcatattctcctgcattgtttggcatcaagataaacaaagtttcagtttctggttttttaatgaattgacttcaaaatcttttctttgttggaggatagacgagatgggtacatggagcaattaaaaaaactaagaaaagttttttgtttaaaaacatcaaatttggaaaagaccctcctaccttcttgtaggggatagctcgtcccactaatggaaactttactgtccaccatctcagagcagagctggtgtgtaagcttgcttcctactatggagagctgcaaaaaggattccagggggactgaattcttccaaggaggatatgatgctatcttctccaggtccttactctctgagacattgtgggtgcccactgcatagatggtgacgcctgcccttcggaggtgggaagcgggtctagatactctgtcttgggagaagccttccgtgatgactacagctatctgctgcacaccgtggttggaccggctacccttctcctgaatgaaaacctcgttcctcaggaaatctaatgcagcaccagtcttcgtccttccttttctttcccggtaggttaatttgtccaaatgctccaagattttggctggattctgaaatgcatccagtgaaaattcaagtcgtggttcctcactgtagaagaccaagccaagtctcacagtatcaggacgaatgtttagagaactgacaatggtctttaggaaattgacaacttgttggaaattgggttgcctaaccctgctaaattcctcaatgaggaatattaagtcagccgggacagcagttgcgcacgctgcaaacagacaaaatcaggaagaacggctttagcataacagcattaatataacataaagacaacattaatatataaaagctgtactatgatgtattttatatgttacataatatatttattattacaattataataatatatatcatatgaacttatatttctacattttataatttaaaagaagcctttatttggcatgatcgtcaaagaacatcacagggttcatacctatttcagaaattctcatgtggaagagtattcacatcacttgcaaaatatttaaatatatgaatattgacagtaaagtgcttcaagattgcttttcaatttatctaagtccatcagaagaatctgagtcttgactaatttttcttcattcttctagtttcaagagactctaggtcaaattctcatttataggcctgaaacctcccaaaagatgaaaattaactgtggctgttaatttctaaacccttctctgatgaatatcatgtcattttaacagaggcagcctgaaatgttgcatgtttctatgaaaaatctttatccaaatattaggccagctggctgtttcattttgctacagaagaactttcccttcgacttacctcagaaggaataaaacataaactcgctgccaagaagaatgcaaacaccactctctctatttgagacagtgcctattgcagggaaacccactgtgtccacatagtttcaaggtccgtatctgctttgatctgtgaaaaaggaaatctccctagcagagagccaaaaccatacatgcagaagcttgaaaccactgtgcaaacaactgaatattgtgaaacaaggtttaggggcaatagaataaccttttaactttctcttttgtctcctggtgtcctgaaatttcccctgtggtcctttttcataaagaatcaaaattcaatcctagattttaaaaaagggtgttgtccacaattttagcaaatctaaaacaccaacgctagaaactccagacatctttgacagctcccttccttcaccttcttgtaccaaatgctgttattctcctttcaaattgtcttcaggattccttccctttcctcattatcaaagccacccttgggctgggcccagacatcctctccatgtggccagatgacagctcagccttaaagtctttctgagtctgaggtgccatttggaaccccacctgccctctgaaggtttcctgaaagactgctttggtcatgtcatacttcttgcttaaaagctgcccaccaattacttctagtgtctttgggatcctgtagtcagggtctatcatacctaatccaatctcatctctcactacttctatactcttccactgatccaaattggctccatttttaaactttcttccacattcatccagaccattcccatttccatacccttaccaggagtgtagaccccttatatggttcttccccttgcccagagtaccctcctcctttctcctatatattaaaataatacctgttatagagggaccagcacaattccttccagcccacatcctctagtatgtcctccttttgtactatctatctctgcttaatatagtatctccataaggtgcttcttagttccttattacctctgtttggattttcctcttcttgtcacatatgtgtttgtcttttttctgcccataaatttccaaggaccccaagctctaattgttgataggtctgggcagaggtgtgacaattctgagaaaggaaaaattggccacttctagttgtggggctcaaaggatgcttcatcaagagggtaacttaagaactgaagggtaaattttgactgtgggcatcacaagctgatattatagtgtattcaagagcagagacagaggttggaaaggatgatatacatacagcaaattatgagtagttcagcttggtcggtgaatagaatgtgtacaaagacttagcaggagataaggctcagtggttctcagccaagagtggtacctatctacaaaggacattttggaaatgtatggggatgttttggattaccataatgattcagggatgatactggcagaaactagggatattaaacctctgacaatgcacaggacaattctacactatgaattgtcctaaccaaaatgccattagtaactcccttgagtgtcttggatgccaacataaggaagtactttatctaatctatggggagaagcctgagtgctccttctcctggaaaaggtatatggtaatttagattcttactcagaaatattatctccttactccttatttccatgggaagatatacttttctactctactgatctcagcatagccatatgactggcttgagccaatgaaatgttagcaggtgatgcagcagaggtttgagaaatgcttatgcaattggttttctctctggtacctctgcaattaccaggagaagaatatgcccagactagcctgatgatcccaggaataagaagagagatatgtggagcagagccaaacctagatcaaccaacacccagacaaatcccaaatctgtgaagaggcccagacaatatcagcaaagctgtttgtttgggcccagccaagatcagctgttcctcaaccgatctgtgagaataagtgattcttttcagccactgacttttcacccagtttgttatgcagcatcattgtgaccatagttaactaaaacaaggttgtgcctgaggcatctcatgcttcctactcttccctgtctgctagtgctagtgccccagtactgaggaatccagaatacccaccttctctgctctttccccagaccttcctcttacactgagatctcccagtggctcacatattctaggaccaaactttacctcctacagcctcctcgttggctgtaatcctgtgttcctgctgtctagtcccttggatcaccacattcatatcttctactatgtgtctgacttcatcttctctctgcacatcatagacaaggtctggggatcccgtcccttccagttctctcctgtcaaagtcctgcacacccacagacataactttcacacctttctctcttagtctctgtgcagcatcctggacttcatcctctgatttgcctgaattaatgaccactgcatactggggaatgccctggagaaacctgcttcctgcttcctcctggaagaatgtctgaagaaggtatcacagtgccttgcctgtcctcctggagcaacccaggggcacaaaatgctcatgaatgtgagctatcatctcattctgggtcttgtaggtattgagcaaaaactcagtgtgaccttggtcaccatactgagccagcccaatttggtacttgtccctgccaacctccagcatgccaaccactctggagaggaaattctgcatcctctggaaactggcccgtgatgtgtcttgtgatgtgtcagcaagaaagaccatgtctgcataggctttgatgaattctggaagtaaagggaaagggagaccagggggccagaaaaagacaaaaggagaaagtaaatcaaatcaaactctcatgaaaattgaatataaggatcgttttgtgtgcccaatgtgagaggtagaagtcctatctttatacaactctctgtatattgtacttcccttcctctatgtgggactctatcacaaggcttttcctctcttatagcctgctgccttgttgtctgttttattatactaacctacctttcaattactcttgttcaaacaatagaggaggcaagggaagttaactgaggatacattttatgctagagctttttatacattttatctgatttaatcctcataagcctttcttctagacaagtattattttctttgtgaagatgagaaaattgaagtgaaaaagtgaagccacttgtccttgctgacacaactagaaagtggcaaagacaggattaaaaaacaggtcttctggctttcaaaacccatgctgtttcctttgaacaacatggcaagatgttcctttctacccacaagaactccatccggccttcaatcctttcccctaggaagcctccccaggttctccagtgatgctgggcactcctttccctcccatacacccagcatattctgggttatattttagtaagctggcatggttggaatcttgggttctaacacagcttcttaccttttatcttaccctccactgctgagcacagagtctgaagaatacttcctgaaaaatcctgcaggatattgaagttttcagtgttgaagagaaacttctcaaatggctcactggttattttttgcaactcttggacatcctggacattgacccctaccacataacacaacaactccatcttctttcaaccggtcagccacctcctggacctcatcatttgactccccgtcagtcaccaggataactatctgaggaactctgtccttggcccgactgccagactcctcagtcaaatagttggtcctgataaactccagggcgctccctgtgtttgtgcctcctgtgcggtatggcagattctggatctgctccaagatcatgctcttcagagggtgctggttcagctggaaggctgggtagatgttgtcattatactgggcaagtcccactcggacacggtcactgctgatgtcaagccccaagatgacggagtaaaggaagttcttgactttctggaagttttggggtccgatgctagttgaactgtctactagaaacacaatgtctgccagggctgcttctctgcaagctataagagagacggcaaaagggattggattactggatcttcactcaaaatgctttgaaccattgaacaaatggttcaagctgcttggaaccaacgcagaaaagaagaataatggcaggcagcctatacttagtggtcctcagacgctaccctcaccccaaatgacaatgtgctcagagcaataacattaacatccccctgtacctttccttctctctgctccatcaccttctgagatttcagacctgctctaccgatacttccaaccttgaaatccacttagataatcccttaaattttattaagaagaaaagcactctgtaaattaagcaacatgctgagaaagggaatgtattctttccagtcagaaaaagccatcagcctcctatcttttgacaaagaaacctcatatctaggagtgtgctggcaccagctggtcagaaagctggaatatatcccatgttccttgacacatcttattgcagctctatcatttaatagctctgtgacctatttaacactcacttctttgagatttaattttcctctctgcagcactgaaatctttacaccaaccctcatactctcccaaggttgttttgaggataaaataagataatctactgcagcagacaatgtcatgttctgctcagtccttttggatttcttttttaccattctatgcactgctctttggaaaactaccctccagctagtaaagctacttttctcacaatatttaaaagcccagatccttgcttgacccagattcagggtcaagacaactttgaggcataatgtacaccaaactcccctgcaggatcaggctaaaatcccttacagaatttttgcctgaaatcacacccttccttacttttctctacttctctgtcctgaataccccacatccttactgaccattgccccgggagctcttccttagcaaatcatgtgtatccaaattcttgtttcaggccctgctccccaggaatacaacctaacagccctgctctagtggaatggctctgctctaaaagatctgggatcaagtccctagttctgcaatccacttgtggtaactttggcttcagttttcttatctgaaaaatgcaaacaataatactaattaccctacgtatctaacaaagttgagatgatcagtcagatgagcaatataaataagttttgaaaactatacaacgccaggcaaatagtagctattattactatgaatataaaatttctttgtaaaccttgaagtgctgtacaaaaggaagatatataatatttatttgcccatacaaatgcaatactaccaccacacacctgctgcatcaatgggtcaaaagttttagcacttcttccaattaaaataccctatacagaaataccaaaataatgaataaatcatgaagagtctgtccttttgtgggttttgatggagcccacaagcattcttctctttctctactcaaagttgtatgctttattatggaggttagtaattaatttataaagaattttcaccattttatgccctatcaccaatagaagcacaaagttgatgacaggcatatcatcatcacaggttatgacaagtaataacaggtaatgtttatgagtacctctggttggccaggtatagtgccaagcactttacttgcacaattttgtttaatgtttttaacaactctctgaggcaggtactatcatcctaggaagaaaatttagattcagagaggtaaagtaacttgtctaagattaccctttctctactttgtaagatttgaacacagatctttattttccctaaattaataatctataatcttaaccagtatattaaaccaacaggcttgcagttaaattagcaaacatcctaggggaactactgcccctctcccttcccatccttcatccaggcaacatgggtaagttaacctaggaataataatgtcattctagaaacaaataaatcttcattcaaaaatggacttatactatatcgtatatagaaccagcataaggcccacaggatttataaaaagagctgatgaggctttggtcagtgattgaagaggagcatagggttggcttcatgaaattttaattttaaaattaaaacatgcacacatatgaaaaataagaaggatgggcagagggatgaataagagaccaagctttgagtttcatgacttccagatcagaaattaagaataaaaagcctttgtacctggagagacgtggtcaacatgtggagctgcctttgccaacgtatcacagagttcctgccgcagcttctgggcgagattgctcagaccagagaagttaggaacaaaggaggtaaaattctcctgaggactactggcaatttccctgagctctgcccaaactgcatctctgacgccaatagcataaagcaggatgcctgccttcctcaatgccttcgcaggtccatggacatggtcctcaactggcccactgctgatcaccacggcgatctgaggtacctcttggcttgcccggctccctgatgcttcctggaagtggtggtctagaatgaacttcagggccaggcccatcttcttgcccccaggcttaaattgaaactgccgaatgtgtctcaacacatcacctttgcggtggtaggtggaaagcaagaactctgaatggggcacatcgctatacttggccagacccacacggatggtctcactgctgacgttgaagctgtttaccagaatgtacaagaagttccgcacactgcgtgcatgttgggggttgatgttggtgtccaccagaaacacaacatctcccagagaggcttccctgcagactaggaaagagagtcactttcagataaaacataacaaatgacagttactggctggaatcccatctctccagactcagagcctttactccccacagatctgcctgcacagcatgcagcctagacacaccatcatcttcccttgtattcccatggctaccatcttcccctgctcacctaccactctctgttccattctaatagacatttggcccttcagttagatcacccaccctgctttccattcatcccttgacctaaataaaagaacccagttttctaccagtagtggatgctgttggtacccacctagatcgcctttactggttggcacacctatcccccagctgctttaagtactacctgtgactttctccagagtcctaaccttggctgaagggagtggcctcaattggagacgcctgggatgttacaccactaccaccaccctgggtggccaatgtctaatcaacatggagatacaaatgcctggcccacttgccttcagtgaaacaaccctgcagtgttatttagactccatcaccacctctcatgactcaggccaaggcttgactttacctattgtcttcatcccctactctaacccacttctgttactcccttacagatttttttcctaaagagtactttctcaaaataatgcactcaaatccctgtcccaaactctgcttccagggaacctgacctaagacatcagctttccagctttgacttctgtactccctggccaccaccagccccttttagtttgatcgttggcattcctatacttgtggctcacatttgtcttttggctccctgagctcaagctgcactatgcagctacttctccccagccccagctacaagcctggaaaccaccatctcaacagtggccaggcccattggtaccccatctgggcccatcctggcctccagcatggaagacatcagacaccaagtggctgcaggactggagcaaattttggtaaattctcataggatcatgttcttttatctttgtttgtaatgtaacattcatgattgtgcttatttagttaatggcaatttccccaactagactgtgagatccatgagaacagataaccatgtattttgtttgtttgttcaccacatgagcatctagcatagagcagatacccaaaaatattgaggaaggaaagaatagaggaaaagagagaaaggaaagagacagcacttataaggatggaaatcttgaacattaatgaaaacaaataatggaattaaaattttagtgctagaaataattatatgagactgtagctgctagacatgtggcaactgagcacgtgaaatgtagctagtataacagaaactgaacttcatattttactgaattttgatttattttaattcagagagtcacatgcagctggtggcccctgtattggacagtacaagtataaaataaggagtccaattcagctatctcaaagagaaggaaaataagacctggaaaggcaaagtaactcatgtaaatccattcaaagagccagaattaggacccaggtctcctgatatctagtccataccctgaactgccatgaagattaaattagaaatccatattacagaaaggcaaagaccaagtgagagtctagacagagagggcttggggaggttggtataatccagggacacttaatccacttgtcacttctggagtcctgggtcccacctctcagaagtttgcataacattggtcataaagccaagtggaatctgatcatggaaaaggcagacaataaatgaacttcaggtcctttaagctttatttcccttcaaccctccaaagtgcagtcttactgggagaattcaatgactgttccagggatggctgactggcttgtcgccttaacatctctttcaggggtgatcaaatgcaaaccacgaagtgtttccctgatctttcaaatcagaggaaaccacacagctgtagaatattttcaaggcaagtaagtttcagttctatcatatgcaacttgagagatgtattacattttcgtagactgtcactttcttaacccctccactagttctttgaatgttttagaaggtgtttgaaacatgaaaagactgtcacagcttctgttcacaagtgaagggagtcagagccaaaaggaaaactgagagagcttcatggtttttttttcccccaacaaataacagcctgtgtaattatatttgaatatttaaacctcaatattgtctcactggcacttcaggctactcaaataatcttcttctgatgagactttcatcttggaaagtcccaacaatctattaaaataactgcaaaaaattgcagatgtgtcactagcactcagtgaagcgatccgtcttgtgatgataattactcctcagaacagctctgccgaagagaaaaggcagaatgcagaacagactcctgtttacaaaagcgtttgagaacctagtaatacatttcagagtatggaagtttttaatatctatttttttgtcatttggggttaagtactgaaaaaacaagtgcccaccattcactataagcttccagattctgactaaattctccttcaatgaatcgattgcctcttattaattctgaagcttctgtaatatttccttttaagatggtcactaccactagatggttttcagcttaaagaaacccaggtattaccaatcctctgtgacttgaagccaaaaccagcttcaaggaggatgatcccccaaaatatcttccaagtctccattctagatgtggacctagagaaaagaagaaaccttgtaattaaaaaatgtgccttcatgcacttaaaatgtgtccaacacattgactataaattatgcctcatgaagttgatttttttaaagcataaggatgtctttccccacatcaacataggctttatcaaaataaagagggaaatgttcccacattgtttcaattgtgcaaggaaaatggtcttgctgatccaactcgggaagaattttgtaaacacccagagtgtacacctcagacttcactatttaaagttgtccagatgtggctataaaaggagaaagcatacaggacatggcatagaacttccatttcacacactgcattcatttggtgggtcataaacatttctgaatgattttgtttgtatatttatgcaagagtggaataacctgataaacagttgtggtatgctaaaatattcaagtatctcaggagcacatctgcctggtcaaataagcctagtctgaaaatacctcatacattctcaaaaaaaaaaaaaagcagaacatcagacctccctccccaaagcttagatccatttccaaaggggtccatggaaattgtctactctcaattccatttctattttttttactctaagaaagtccatttgtttaaaaataagaacataataatcccattgaatgagaggttccaagtggaacagggaatacctcatctttatattcttggccagccaatctcacagctgccttcagcagaatgtatgtggttaaaaagcaaggactcttggagatagactgcctgggcttgagtcttcgatccactatctaatagtggatcttaggcaaattgcttcacttttctctgccttggtttccccatttgtaaaataggggcaataatagcacctaccttatagtgttatcaggattgagttcattattataaaacactttacccattcctggcacacagaaggcactctttaggtgtttgttaaataaaataaaccttcttggagccccaatatgtaattcaaaagaattcaaaagaattcttccatgtctttgccattgtgaatagttaaagcacattcttaaacaaaccaaagagtttaagcaagaatctctagcatgtctaaatcacttcctagtcttgggttctttaaatagaatattgtgtggaagtgatcatcacaacacccaggaatagcagacacccaacagctgcgtttctctttccagaaagtgttaagtgaaaaccaccccccactccctaaaaacacatcttgactgttcatgctcaacttactccttaagagggattcaaaaatttgagataaccatatttattttatttactttattatttacaccaacagaaaatactgggagaagtcttgactttaaaggaagcccataggccttgattctggtttgagcttggctatttgctctgcagacttgagcaagctgtttcaactttcaggttttatgtgatgagtctagaggtcttagctctgatttgagacaactactgtattgaccactgtattacaaacatgccctagggaattggtccagtgtttttccaggaaatagatgtgctataattagatttctctgttcctcagtttctacataacttcccactagtgcctcctcccggaggtgtataagtaactaaaggaaaggtactttaagactttagatatcctatccttcaataaacttttacctaagggtaaaaaaaaaaatgcatgaatcttaaagaatagattgccctagtgaattaataactgtatgagggtaaagagcttgagagtctgaaggtgtgaaaaatgatccaaaataaattaatggatcatcaacatgatcctcatcatcatcattgcaataaaatattacacttccaattttgaaacacttgggttaataaagttattggaaaaaacaaaacctttaagtaaaggttttactgtataaaacctaaatatagatattatgtctacattttcattttccattatgtcccaattattactattcatgcgattagtcataaaaaatgagcatttttagctaattgtaaataaagcactagagctgtttatgaaactctagtgggaaagtcaaaatgataaacatttataaacggttgtaaacattttacagctgggcaagtctgtgttatatcaatgaagagttaagtatctatgtattagagatttaatatctacgtgatatgtactatttcattaagatgtttatatcttaagctgctgaagagattttgcatctgaacacatgggactcctcatggaggcaagaaataaagccattaaatgaaatggaattagatagggatagcatagaatactgattctttctgcaaataactttaatagttttgcaatagaaaagatttctctcaaaaatatattgctcaaatagttaaccaactaaaaccgtctattttttagattcatttattcagtttaaaaattactttgcaactaccatagtaacaattgactcaggaagaatcatcagagattgctaaaaccactgggtaaaagtttgttacacaacagaatatgaatatattttcaaagtatcttctgaaaaattacttagaaattacaaagggcaaaaaagtaccattacgatggagaagcctgatggacatgacttaaccaagtgatcaattacatcaataataacaggataaaccaacatcatcacctcctgatattatgcatgagaaaacttaacatcacttatatagtatttctccttaaaatccatgacctaaatctgataacgagaaaacaatcacataaaccaaaacttgaggacagtctaaaaaataactggcctgtgcgtctcaaaaatattcatatcatgaaagacaaagcaaaggaattgattcagattataggagtccaaagagacataacatataaaggcaattcatgatcctggtttggggggaaaaatgctataaaagccattgaatgagacagtagacaaaatgttaatatggacagaatattatataataatactgtatcaaggtcatggtgaaacccggtttctacaaaaaaatacaaaaaatattagctagccatgatggtgcacgcctgtagtcccagctactcgggaggctgaggtgagagaatcgcttgagcccaggaggttgaggctgcagtaatcgtgccactgcactccagcctgagcaacagagtgagaccctgtctcaaaaaaagaaaatacggtatcaatgttaaatttaataactttgattattgtgttgtagtcatgtaagagaatggccttcttatttaaaaatacacactgatgcattgtggagcaaaggaccttactatcagcaacttactctcaaatgcttggcaaaattataatgattcatagagagaggaataaagcattgcaatacatttgcaactttttactgagtgtttattgtttgccagactaaacttcaggccctagaaataacagactaaaagaaaccattctttttctcagagaactagtggagagagagatggataaattgtaatattgtgggataagcaaaataaaatagaaagctatacaaagtgctgaggaacacagtgtgtgagcacctgtcttcacctgggtgaagagtttacagagcagatgattccagagtgaagacttgaaggatgagtagaaatttgcaagtgagaatgtgaagaaagggagttccaggaagaagaacagcatgtacatgcaaggacactggagaggtactagacactccaaacacagcctgcccacagattcaggagctcaggtttaggagtgctggggatgtggttaggccttcattagagctcatgcacctgtgctgtccaagctcttaaggcttgataagtctcatagagatcttttctgaaatgactgaacttaaaaggtgggatagaagaggggacccgagcagaattcctcagtcttcaaaaacaaacctccttaacttcatttaattaaagtagcaatgctttatataccagtctccttcaaggtttttgttcttcctctgtggaatgctcaactataaaatacgaagattccatctctaatgtcctatgccagtgactcttaaacttcagcattgcatcagagttacccagaggacctgttaaagcccagtttgttggcccctacctccagagtttctgattttgtaagtgtagtgtgaacccttagaatctgcctgctgagctggtccgaggaaccatatttcaaaaaccattctttaggccgggcatagtggctcatgactataatcctagcactttgggagaccaaggcaggaggagtgcctgagcccaggagctggaaaccagcctgggaaaaataaagagaccctgtctctacaaaaataaaaataaaaattagcctggtgtggtggtgtgtgcctgttgtcccagcttctcaggaggcaaaggtgggagaattgactgagtccagaagtcgaggctgcaacaagccatgatcatgccactgcactccagcctgggtgacagagagggaagggaaggggaaggggaaggggaagggagaaagagagaaagagagagagaaagaaaggaaaggaaaagaaaagaaaagaaaagaaaagaaaaggaaaagaaaagaaactagtctcccatgcatttagcatgcagtggttcctgctcaagcgagtgtctgccccacttgctttcaatagcctctttaattccctatggagaaaatcaagtgtctattttcaagtaagtgagaaaagagaagagattattgattttaaaatgttttttaaattactgaggtaagcagaagcttcaaaatatttggatgaaatactcaatgcaaatatgcaaaattaatttaacacattttttccattttctttctatttattctctgaaatccagagctgtgctctctcttttctttctgttcactttaacagggttattacaataactggatttttggctttctaatgagatagtcttacagtgttccacatctgggcaggaagctccagaaggcaaacaattgagaaacgtgaatagattcttctgtacacttcacgttaaactctacataacatgtttgacagtaaaaaaaataaaaataaaaaactaaagtttagccttaatttattgcataaacattaacatttgttttctgtgctcattcacaaatcttacaatggctcagataaatctataactttgttgtaaaatatttaagggaggctatgtcaaacatttcaatgacaattaatgtgtcagtagtctcagaaaaaaataacaagatgcagaatcttggagctttcctccagagaagggtaaggattaaaatgccagagttcagcggagctctgtgcaaagcaataaatggctgttgatggttatgatactcccatcagctgtggaaattagtagattggtacataattaatttgtgaggtacttaaaattttggaacactacactaagaaaataagagaaaagaccaaataaataaaatgagaaatgaaagtggtgacattacaagagatgcttcagaaatgaaaaaaatgaaaaagaactattatgaataattatatggcaacaaattggataacctagaggaaatggataaatgcctaaaaaaatgcaacttacggagggaggagccaagatggccgaataggaacagccccggtctacagctcccagcgtgagcgacgcagaagatgggtgatttctgcatttccatctgaggtaccgggtttatctcactaggagtgtcagacagtgggcgcaggtcagtgggtgtgcgcaccatgcgtgagcccaagcagggcgaggcattgcctcacttgggaagcgcaaggggtcagggagttccttttctgagtcaaagaaaggggtgacggacggcacctggaaaatcgggtcactcccacccgaatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccggaaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcctagcacgcagctggagatctgagaacgggcagactgcctcctcaagtgggtccctgacccctgacccccgagcagcctaactgggaggcactccccagcaggggcagactgacacctcacacggtcgggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaataactggaaactctaaaaagcagagcgcctctcctcctccaaaggaatgcagttcctcaccagcaacggaacaaagctggatggagaatgactttgacgagctgagagaagaaggcttcagacgatcaaattactctgagctacgggagaacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtctagagaaaaaagaataaaaagaaatgagcaaagcctccaagaaatatgggactatgtgaaaagaccaaatctacgtctgattggtgtacctgaaagtgatggggagaatggaaccaagttggaaaacactttgcaggatatcatccaggagaacttccccaatctagcaaggcaggccaaccttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccggtaccagccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacggaaagtcaacaaggatacccaggaattgaactcagctctgcaccaagcggacctaatagacatctacagaactctccaccccaaatcaacagaatatacattcttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacaaaatgaaggcagaaataaagatgttctttgaaaccaacgagaacaaagacacaacataccagaatctctggaatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacagaaaaaacccttcaaaaaattaatgaatccaggagctggtgttttgaaaggatcaacaaaattgatagaccgctagcaagactaataaagaaaaaaagagagaagaattaaatagacgcaataaaaaatgataaaggagatatcaccaccgatcccacagaaatacaaactaccatcagggaatactacaaacacctctatgcaaataaactagaaaatctagaagaaatggataaattcctggacacatacactctaccaagactaaaccaggaagaagttgaatctctgaatagaccaataacaggagctgaaattgtggcaataatcaatagcttaccaatcaaaaagagtccaggaccagatggattcacagccgaattctaccagaggttcaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatcctggcaaaacgaatccagcagcacatcaaaaagcttatccaccatgatcaagtgggcttcatccctgggatgcgaggctggttcaatatacgcaaatcaataaatgtaatccagcatataaacagagccaaagacaaaaaccacgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcacgagtgaactcccattcacaattgcttcaaagagaataaaatacataggaatccaatttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagaacccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgacaaaaacaagaaatggggaaaggattccctgtttaacaaatggtgctgggaaaactggctagccatatgtagaaagctgaaactggatcccttccttacaccttatacaaaaatcaattctcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgaccaatgagatctaattaaactgaacagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaccaacgggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactctaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaagaggaacatcacactctagggactgttgtggggtagggggagtggggagggatagctttaggagatatacctaatgctaaatgacgagttaatgggtgcagcacaccagcatggcacatgtatacatatgtaactaacctgcacattgtgcacatgtaccctgaaacttaaagtataataataataaaataaaaaaaaagttgctgctatcttagagaaatacacagctgagatacacaatgttcctattcttacagcaatatgaacatcagctaaactggaaaagctgcactataataaactgtcttcaacacacacacacacacaaaatagaccattagccagactaataaagaagaaaagagagaagaatcaaatagacacaataaaaaataataaaggggttatcaccactgatcccacagaaatacaaactaccatcaagaattctataaacatctctacacaaataaactagaaaatctagaagaaatggataaattcctggacacatacaccctcccaagactaaatcaggaagaagtcgaatccgtggatagaccaatcacaagttctgaaattgaggcagtaattaatagcctaccaaccaaaaaaagcccaggtccagatggatttacagctgaattctaccagagatacaaagaggagctggtaccattccttctgaaactattcaaaacagcagaaaaagagggactcctccctaattcattttatgaggccagcatgatcctgctacaaaacctggcagagacacaacaaaaaaagaaaatttcaggccaatatccccaatgaatgtcgatgcaaaaatcctcaataaactagtggcaaacagaatccagcagcaaaaagcttctccaccacgatcgagtcagcttcatccctaggatacaaggctggttcaacatatgcaaatcaataaacgtaatccatcatataaacagaaccaaggacaaaaaccacataattatctcaatagatgcaggaaagtccctcaataaaattcaacaccgcttcatgctaaaaacactcaaactacatatcaatggaacatatctcaaaataataagagctatttttgacaaacccacaaccaatatcatactgaatgagcaaaagctagaagcattccctttgaaaaccagcacaagacaaggatgtcctctctcaccactcctattcaacatagtattggaagttctggccagggcaatcaggcaaaataaagaactaaagggtattcaaataggaagagagaaagtcaaattgtctctgtttgcagatgacatgattgtatatttagaaaaccccatcgtctcagcccaaaaactccttaagcagataagcaacttcagcaaattctcaggatacaaaataaatgtgcaaaactcacaagcattcctatacaccaataatagacaaacagaggcaaatcatgagtgaactctcactcacaattactacaaagagaataatatacctaggaatacaacttacaggggatatgaaggacctcttcacggagaactacaaaccactgctcaaggaaataagagaggacacaaacaaacagaaaaacagtccatgctcatggataggaagactcaatatcgtgaaaatggccatactgcccaaagtaatatatagattcaatgctattcccatcaagctaccattgactttcttcacagaattagaaaaaactactttaaatttcatatggaaccaaaaaagagcccatatagccaagacaatcctaagcaaaacgaagaaagttggaggcatcatgctacctgacttcaaactatactacaaggctacagtaaccaaacagcatggtactggtaccaaaacagatatatagaccaatggaacagaacagagtcctcagaaataacgccacacatccacaaccacctgatctttgacaaacctaacaaaaacagccaatggggaaaggattccctatttaataaatggtgctgggaaaactggctagccatatgtagaaagctgaaactggatcccttcctttcaccttacacaaaaattaactcaagatggattaaagacttaaacataagacctaaaaccacgaaaaccctagaagaaaacctaggcaatgccattcaggacataggcatgggcaaagacttcataactaaaacaccaaaagcaagggcaacaaaacccaaaattgacaagtaggacctaattaaactaaagagctcctgcacagcaaaagaaactatcatcaaaatgaataggcaacatacagaatggaagaaaatttttgcaatctatccatctgaaaaagagctactatccagaatctacaaggaacttaaacacatttacatgaaaaaaaaacccattaaaaagtaggcaaaggatatgaaaagatacttctcaaaagaagacatttatgtggccaagaaactatgaaaaaaagcttatcatcactggtcattagagaatgcaaatcaaaaccacaatgagataccacctcatgccagttagaatggcgatccttaaaaagtcaggaaacaacagatgctggagaggatgtggagaaataaggatgcttttacactgttggtgggagtgtaaattacttcaaccactgtggaagacagtgtgacaattcctcaagtatctagaaccagaaataccatttgacccagcaatcccattactgggtatatacccaaaggattataaatcattctactatgaagacacatgcacatgtatgtttattgcagcacaattcataatagcaaagacttggaaccaacccaaatgaccattaatgatagattggataaagaaactgtggcacatataccctatggaatattatgcagccataaaaagaatgagttcatgtcctttgcaaggacatggatgaagctggaaaccataattctcagcaaactaacacaggaacagaaaaccaaacactgcatgttctcattcataaggtggagttgaataatgtgaatacatggacacagggtggggaacatcatacaccagggcctgttgcggggtggggggctaggggaaggagagcattaggagaaatacctaatgtagacgacgggttgatgggtacacccaaccaccatggcacatgtatacctatgtagcaaacctgcacattctgcacatgtatatcccagaacttaaagtataataaaataaataaataaataaataaataaataataaaaacacaaaaaatcataatggatggttactctgctcactacctaggtccaatgtacccatgtaacaatcctatacatgcatcccttgtatctgaaataaaagctgaaaacttttttaaaagtacacatacaaaaattttaaaaagcttaagaacaacaacaatgaaaaaaaaaaaccataacgtggaaattctggattgcattcagagactgtgtagatggaatggaagtctgagctggtggaactgctctcaagacaggcgtagttttattttgagctgaaaaggttccggcttgagtagtagccatcctgttgatgttttaaattctactcatactaatatggttccctgtgcctgggaaaaactgtgtataaaccaacacaatttccacttgttgtgtaataggaatatctgctacagcaaaatttcttttgaaaagggagaaaacaatcttattttctatttctactgaataaaccagcttgcaatcatctgaaaagaataaacttccttaatttgatgccattatacatttaacctttgggaatttgtgaagtggaagcactttcaagttcctgctctggaagaggactgtgaatactattttagccatcagccacgtagaagctgtaactactaaaacaatgcaaattatgtcatccagtccaaggtgtctagatgataagagcaaggtacaagtgagtggcattttatgatttagcctcataagttagatggtagcacttccactatacactattagtcaaggcagtcacaaagttatgtccaggatgcatggtaggggacaaagatcctaccgcttaaaagaagggacatgaagatacccttgtaaggagatcacgtgggatgtaagataaagcttttggcctatttgtaaaatacagtctgccacagtttgctttctggccatatttctcatgcctcccacatgcaaaatacattcaaatcacacccctagaattctcaagtctcaaactattaaaacatcagcttgaagtccaggagcttgtcatctaaatcaggttcaggtgaagatgagatgccttggtgtggttcatttgggtgcagctccttaaatatcactccttttgattagagctctgttaaagagacaatctgcacccccccccccgcccacacacacacccaacgcacagtgataagaggcataagatgatccctataggaaaatcctactcgaaagggaggaagaggcaagcacactgcaataatctagaaaaattctgaaatgcagtttggtatatgcttccagttccttatcaagattcagtcctactgtctgggagttctctgtgaatttcaaattccaaaacacatctggcttaagggtgcagtaaaggattgtgaagctgcactcagagactataagaaaaagatgtgataaacactcccattgcctatcaatgactgagctcttcagaggatgctgttgttgcttctgtttcccaagatgatcagagttcaggaagtggaattccaagcagctcagaggtaaatgagataagggttaaatggttctgtaaccatttcttctgcccctgcactgacagattatcccaaaagaacacagtcatgaagagtaaagagcacagtcaagtgttgcaggacataactttgtcaaatacttcatatgtgccaggtgttgtgctaaaggctttactggcattatctcattcaatccttctaaaactttatgaggtagttactaatctacctattttacagatgagaaaaattgaggcttagagatattaatcagtgtgctgaaggtttgcaaagttagaaaatggtaacaaaattgtgaaatgactttctccatcaatttgcttgttttcgtcattagagtggacatgaaaaaaatttaatctctacatcagcagtccccaacctttttggtgtcagggaccagttccatgaaagaccatttttccacagactgcggggatggggaggggatgattcgagcacactacatttattgtgcactttgttactactattattacattgtaatatatgatgaaataattacacaattcacataatgcagaatatgtgggagccctgagcttgttttcctgcaactagatggtcccatctgggggtgatggaagacagtgacacctgaaatgtgttgcttatgtccagtctactccataatctcattatggtttctctcactacaaaaaaccctgcttcataaagataggatgttagaaatggaagcaggcttttcagtgcttttgtggcaatctcaggctaccactttgactttagtccagaacatacgaagatttgaagttgtctcaaacatacttttaaggccaccatcatttgcaatctcaagcagttgatcctcttctagcacaaagttgatttacctggcttattcacaaatgggttgcagatccattccttcctagtttgggggtcttttgtggttgggaagtaatgctcaaactcttttgaaaactgagatgggtgatcatgcaccggctggaagaaagaaggccctggctcagtctctttcaaaatctctgctaatgtttgaaacatgtcaaaaatcccagtgttcccttgtcacccccataactccagcttggctttgaatgcagccactttatctgctgacttgaacacagttgttgttctcctctgaagtgatagattgagttcattgagcaggttgaatatgtcacacaaggaagcaagttttgagacccattctgtgtcactgaaatgtgctgccaatggtgactgtttttctaaaagaaatctctggaggctcataactcagaaactctggccagtgatctacctttagaaagccacctcacttctgtgtataagagaagacacgtgtgctctgcgtccatcttctcacagagctgcgtgaacagatgttagttaagggtatgtactttaatgtggttggtaattttaatcacatcctgcaaaacgttaagttcaggtgacatttttcagctaaccagcatttttctatggatgacacactgcatagactcacattcacaagcgacctctttgacccaagcagtgaaaccagaaagccatctagtcatggcagccactatgtccttgcataaactgacacaaaatgatcaattcagtttccagacatgtaatcattcaaagacttaaatagttctgcagctgtggtattggttggcaacaaaagtacccaaaacatacccttatgcacatcctcttgaaaaatatgtcacacaaaaacaaatattgttgccttgttgtcaacatcagtagacttgtcaacctggattgtgtactccagtgactcattaatcctctctaacaattgtgcctcaatatcctctgctatttcatcgatgcctctagttacggtaccaaccaaaagaggaacacgtgccagcttttgaactgcagcccctcctaaaagttcatgacaaatgtcctcagcagcaggcaggatcagctctttttcaacagtaaagggcttcttagctttagcaatgtggttagccactaagaatgatgctctcagtgcagacacatttgatgaagtggtggccttcagtaattgcttctgttcttcatgctcactttttttctttgggaaaactccaaagacttgtgttttaatgcagggtgcttggtctccacatggcaaagcagttttgaaggttttatgtcttcattggatagccggttgccacacattatacaacgtgggcttggagaacgtgaatcacctgttgcaatgaacccataatttaagtaggactcttggtatttttttaatgcagctttctttctgttggcagtcgtagagtcttctgctgtgtcatcattgggtctttccccttttcaaataagttttccagtgacaactgatttttactcatttgggtttgggttagcttgtgggcttaccaaaactgactgagacaagtgggtagcgtgggaaagaggactgcaggccacgcactccacgtgaggactaaaataagtgttggattctaacttcaagcctgccaccagatgcagctgtacaattgaagtacatcaactcagttaccactataaagcctaccaccagatgcagcttcattgtcacttgccgctcactgatagggttttgatatgagatcacaagcaatttattatggtctctgtgcagtcaaacctctgctagtgttaatctgtatttgcagccactccccagcgttagcatcactgcctcagctccacctcagatcatcaggcattagattctcataaggagcacgcaacctagatccttcgcatgcagagttcacagcaggttttgaactactatgagaatctaatgctgtggctgatctgaccggaggcagagctcaggcagtaatatgaatgatggggagcagctgtaaatagaaatgaagcttcgctcacttgcccaccactcacctcctgctgtgcaacattgttcctaacaggacagagatgatatcagtctacagctcaggggttggtgacccctgatctactttgtccaatgaaaactgaaagtgtaaaattggtgaactgtatcaacgtcaatttcctggtcattatgttgtactagagttatgcaagctattactactgagataaactagataaagtgtatatgagatttctgtgttatttcttacaatagcatgttaagttacaattatctcaaaatagaaagcttaattagaaagaaaactaaaactgtgctccaaagatagtatctccagacttctcttatacctttttgagggacaatgcaatactttggacaatgcaacaggaaaactgaaggctaatttaataattattatttcacaattactttatccatttaggcatttcatctttcttctgttgtcctattattttagtatttttaaatgatagcttgtaattattgagtaatgatgaaataattcatagaatgataaaatatcaaaatattttaacatgtacagaaggatcccaaaaggtagcttagattccaaaaggtagcttagattataaagggatccaatgggctcatatggtaatcgtaagatagaatgagctttattatatatataggaaaatttataaatatataatatatatttataaatgtatatttataaatttatttatacatttaatacataaattcatttataaatatatataatttataaattaaaattttatcttggttctttggaagatctctaataaagaacaaaagtcattgaaatatcaatccttacaaatatttagaacccctctataaagaaactcaaattaaaattgagtgtagcagtccacaatggtgtactgagaattaagatagaaacccaaactcttaacagggcctacaaggccctacatggtctcatgcctgacaccctcaccttctgagcctctgcctgcatttcactgtgtctgctccagctacactggcctctgttccatgttcagttttgccactggccactgcacaagcagttccttctatctcagggaaagtctttgctgaccccctagttcaggtcagtttccttttcataagctcttacaaaactgttgattacctttggagtactcgtctacatttgtaatgattcattcactaatggcctttattgattgattaatgcctgtgtcctcccagtaggccaaaagccctatgagaggagggcctgttttcacaccactgtatccacaaatgtcagcatttaccttctctccttcttgagactgctctaaaattatgtaaaggaattaaagtaccaagaaaggatcaaaataacaggatatgagcccagtgtagcctgtagatgtgcaatgttgtctcttagtacttagaaaaacatttcactggccaggagtggtggctcacaattgtaatcccagcactttgggaggccgaggcgggtggatcacctgaggtcagcagttcgagacgagcctgaccaacatggtgaaaccccatctctactaaatacaaaaaactagccgggcgtggtgccgcatgcctgtaattcaagctacttgggaggctgaggcaggagaactgcttgaacccaggaggcggaggtttcagtgagctgagattgcaccattgcactccagcctgggcaacaagagtgaaaactctgtcaaaaaaaaaaaaagggggaaaacatttcactttatttttacttaaaagtcagtattttttacaccaagatttaaatttctggcttctcttgatttaaaaaaatatattggacctacgttcccttgaactgtctagagctagtagtaactgccccaactcacttcttcctaaaatttgcttctcaaatttgctccataccttgcctcagggatggtgctgttatctctaaagagccccagagagccctggacttgaaaattattgtgctcttcagggattatggtagatatttatttatttattttagatggagtttcgctcttgttgcccaggctggagtgcaatggcgtgatctcggctcactgcaacctccgcctcctgggttcaagcgattctcctgtgtcagactcctgagtagctgggattacaggcgcccaccaaaatgcttggctaattttttgtgtttttagtagagacaaggtttcactatgttggccaggctggtctcgaactcctgacttcaggtgatccacctgcctcagcctcccaaagtgctgggattataacctatgcctccctggttcaagcaattctcctgcctcagcctcccaagtagctgggattacaggcacctgccaccatacctggctaattttttgtatttttagtagagatgaagttttgccatgttggccaggctggtctcgaactcctgacctcgggtgatccacccacctcggcctcccaaagtgctgagattacaggtgtgagccaccacacccggccatggtagatattttaatgaaatgtttgttgaaaggataaagttgtgaccacaagcccctatgaggtaacacctagctgcagtgccacatatgaacacaaggtgacagtgtgctctcaggaatctgcataaacccagcacagttggtgaggatctgtagtaaataggatgacttgtcccacccaactgtgagagagggcaactaccaaagaccaacagcaacatagcatgtgtcctagagggtcacaggggaaaaaactaagaaggaaggaagcttcaaggccagggatccagcacagcagagatgggactgcagggagggaatttaactcacccctgtctttgctgtccttagcatgatccactcttcccctgagtgctgaatttcaaggccatgaagccatggtcaagagacttgactgggaacgggccttaagctttcagtgactcccttctaaatctagagcagtggttctcaaagtgtggtctctgcaccagcagcatcacttgtcagaatctgcagaaatgcagattcccaggccctgcccaaccctactgacccaggcattctaggatggagcccagaaacctatatataatcagatccctgggtggttccaaagcagctaaatgtgagaagcacagctctaaagtctcattttccatctcttcccacagccacacccagtgaatcccaatcctcaaaatacacggacctcaacactcctgcctctagttgagactgaaacatccatctcttcctctcctgctttgctcttattctgcctttgggactcaactcaagccacctttcttctggaacactgtgttagactccccaagctgatttaggtagtgctcctcccagcctctgccttctctcttttagcaattattaaatgatgcttttaactgttggctgctgaatgtcttgctcaccacagtgtgagctgtctttacctccagtgcctggccaacagaattttgcatatgtatttaatgaaataataaactaccatcatttggttggcagctttaaaaagggtaataacatctttttcacctacagtagaattttatatacacacatatcctaacttaattttatatacatatttaaaatatatagaattaaatataatcttaatagattccatatgtaattatatgcagattataagctccctgcaagtctaaatttcaaaactatgctctgctgtttctgacatttgtaggacaggccaaggaattcaacagtcaatagcaatagccatttaaccaaagggaaaaaaaaaaccaacaaggagcttcctgagcaggggtgtgtgcagaccagtgccctctcaatgtctgtctccaggtctcatccctctctatgtctgtctcagctctcggtgggggagggctcccaagctgcaggatgacgacatgttgactatgcagctctgagtgcttaacattggacaaattccactgtcacagagctggcctaaggtggaggtggtactggacattctggcaggcattccacaaaggcacatgtcgtgagtctccaccaccaagttctcagagttttttggataattgatgatcacagaatacaaggtcaatatataaatgtcaatgctatttgcatatactagcaacagttggaaattaaagttaaataagcgataccatttacaatagcatcaaaaatatcaactgcttagaaataaatctgtcaaaagatatgcaaggcccatgcatgtgaaaactacaaaactgctgagagaaattgaagaagtcctgaagaaatggagaaattgacgatgctcatggattggaagactcaattttgttgagactgcaaatattaatactttgaagcttcaatttgctttacccctgccttgtctcactgtctcctatttggctttgtatcgtcaatgtctagctctgtgccaggcacaaaatagtttggtgttcactgaatacatgaacaaggaataaggattcaattccttatacagaatataggaataaatataggaagagatctcaactacctgggagtgcaataaaaggcttccttcaagatgcactaggaattctataagctgtgatgggagcaggaaccgaagtcctgtgaggagtaaaactatatttatctgctgtagcttgggggtcagtttgtgcaaaacagtgactgaaacacatatggcctgaactcatgtactgaaggactttctcacattagatatatttaagtagtggagttgactcattcaacattttaaaatatttgttgaacacctgctctggaacaaggcttgcgctcaacgctgggatcaaagtggtaaagacaggaagcatccctgcttcagctataaaactgtagttgctacctttgagagccatctttgggccaggcacaaaatcaaattctgtgtgtctttataacagcctgatgagaccgttgttattaagaacttcactaaatgtgaagaaatacacttaaactaagaaattagagtcccattttaaatgcaggccaaatgactgaaaaaaaatttagagtataattaaaaaattaaaagtacacacttaaaatgtagtttgataagttttgacaaacgtatatatttttacaccaccattgagatataaaacattctcatcatccgaaaagattcctttgtatccccttcccaaccactgatctgctttctaacatcgtagtgttttctagtgtttcttatagatggaattatacattatgtactcaattcttacttctttgactcagcatgaatttggtggtgcccatcactaattcatttttattactgctgacttcagacctttaggggagagaagacataaatcaaataatcacctaattaagtatttaattacaacagcatcaagttaacctaagggtaagtacaagtggaaatacattaccttgtttgttaacaattcaatcaatacgaccttggtgtacagtggggggctatagggtcatgattcagcttgtggaaaacaaatgaaaataaatgttagcgaagagtgactctaaagaacctctgtcctcacggtaatttttttaatgtgtcagatgctggtgggaggcattcttccttagctctttactcccatcccttacacttaacagaggaaaggatctgtaaggcgcgtacccctctactgcccactgtcgacgaaaacagcctcgccctgcaccgccaccgccacgcataaggcggtgtgtgggcagctcggacgtggcacctgccctcagctgctcaatcccgggcgccgcgacggtcacgtgcacagcggcaggcctttttgccccgcccccgcggcccggctcctgcgtgggcccggccccgcccacagcccgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggtagggccgggcccggcgcttcggtcggagttgctcagtcggagtgcggcccgggcctgcggccgaggggcgggatccgggtgcggaggctagcggccccggctttgcttttccctcgtccgcctcccggccctcctcttgttgggagcggcaagcccgagtgcagaggccgacgctgaggctgcggggaggctgggtcgcggcttgcagccgccgctcctccacctgtagtcctgactggcaaatgcccaccgttgagccgctttggggggcaggtgttagatatgggtagttagtagccaattcttgctgtcacttgactctgatttacagctagcgggaaatggcctgtgatatatatcaaaataatgcatgctcgttaaataaacttaaaaagaataaaaaccatctcctgtcatagcatttgacatacagtcatgcgtccttagcgatgtgatattttctgagaaatgtgttcttaggccattttgttgttgtgcgaacaccgtagaaagcgcttacacaagcctgaatggtacagcctgttccacacctaagctgtatggcatggcctgttgctcctaggttacaggcctgcgcagcgtgttgctgtactcagtggtgtgtgcagttacatgcagtggtaagtatttgtgcatctaaacatagaaaaggtacagtaaacatgcagcataaaagataaaaaaaaaatactacaccagtgtggggcacttacccacaaaaggagcttgcaggactggaagttgctctgagttggtgagtagtggtgagtgaatgtgaaggcctgggacattcactgctctactcttgtagactttataagcagtgtacccttaggctacgctaaatttttttaatctttcttcagtaataaactaaccttagcttacggtaacccttttactttataaacttctaaattttcttaactttttaactcttttgtaatagcttaaaacgaacttattgtgcagttacacaaacattttctttatatctttatttggtaagtttttttgtttctttttttttttttattctttagttaaaaactaaggcacacgttagcctaggcctacacctcgtcaggatcatcaatattactgtcttccacctccaatcttgtcccactgggaggtcttcaggagcaataacaggaatgaaactgtcgtctcctatgataacaatgtctcttgaaatatctcctgaaggacatgtcagagactgttttatagttaacttttttttataaaaggagtatactaacagtacatagtatagcatagtaaatacataaaccagtaacatagttgttgattatcaagtattatgtactctacattattgtgtgtggtagacttttacaccactggcaccccagtaggtttgtttacatcagcatcaccacaaacatgcgagtaaagtgttgtgctatgacattatgatggctatgacatgaccaggcaataggaatttttcaactccattataatcttaggggaccactatcatatattcagtctgttgttgactgaaatgttatgtggtgtgtgactatatttttgtgtttttttatgcgtatgtgtatatgctttttttttttttttacaaactggtttatactgtttttagtaatagctgcacagtagttcattatgtgggtgtaccatatttttttttttaagagacagcgtcttgccctgtcactcagcctggagtgccgtggcccactaataatagctcattgcagcctcaaactgcaaagctcaagcaatcctcctgcctcagtctcccaattggtgggactacaggtagacacaaccacacttggctaattttttttttttttttttttttgtgtagaaatggagtctcgctgtgttgcccaggctggtttcgaactcctgggtcaagcgatcttcctgcctcagtctcccaaaatgctggaattacaggcgtgagcctctgtgcctgtccagtgtactataattaatttacagactcttgggcattcagttgattttgttttttcaacatcataagtaacgatgtagttcatatctttataactaattcttatgactagtgcaaatttttgcctgaattttctttgggataaattaccggggacagaattgataaatcaaagggtatgagcttccatggtccactctcttctctccaattctgaggatttgcaaatatacccctctagctctagctagatttggagggagctgtgtcctcatgatagtgtcaccttttcttttagaaagattatcagactttgataatactgtacaatagtagtactttttttcacaaatgtatgtgctgtcaataaagtgtggtttgtttcagattaatattttgttgctttcattttataatcttttttcctttttttttgagacggagttttgttcttgttgctcaggctggagtgcaatagcacaatctcgactcgctgcaacctccacctcgtgggttcaagtgattctcctgcctcagcctcctgagtagctgggattacaggcatgcaccaccacccccggctaattttgtatttttagtagagaccgggtttctccatgttggtcaggctggtctcaaactcccgacctcaggtgatccacctgcctcggcttcccaaagtgctgggattataggcatgagccaccgcccccagcctatttttttctttttttattgataggtaatgtacatagtttcagggtacatgtgataatttaatacattaatataatttgtaaagataaatcagcatacttgggatagccatcaccttaactacttcacagctgaactgtgcagcttttattactgaatattattcccttaatatttatgctaggaacatttgaattaatctagctattttgaaatgtacaatcaaatattataaactctggtcaccctgtgatctatcttaacagtaggtctcattctattataatctgctttatgtttagagagttttggtgcatttcagaatccttttagacttttttgacaatttcacaaggcattgtttaagagaaaaattgtgtgtgttttgtgaaatagctttgacaacaggttaaaatagtgctatataaaaatagattttattaaagcaaaagaaactgctatgcactgccccttgtttcctatagacttacatacatgtcaggaagaattttttatctttgagaaagccaaaaaaagtggttgtacttctagaaattatttatataagcttcatcagtttagtatttagtgttttctgcccagtcctttctataagctatttatttcttgtcagttttgaatataaatgaaatgagtaaaataaaattgacaccagcagttttttaaattggctttattttatttttcagagacagggtctcattctgtcacccaggctggcgggcagtggtgagatcataactcactgcagcctcaaactcctgggctaaaacaatcttccagcctcagcctcctgagtagctgggactacaggtgtgcaccacaatacctggctaattttttttttttccagaaatggggatttcactatgttgcccagttagtcttgaactcctggcctcaagcagtcctcctgcctcagactcctaagtaaaaaaaatagctttttttaaaaagtacaataattatttggaaattaataatcacatacaagataactgaaggggcaatatatgtgtattatatacttatataatttacatgtatcaaaaacattccgtttattggatttaagtgtagttacaatgtatttagataatgatggtatgtaagatatatttaatgtttacatgtaaagttatactttcctcctctgaaatagttatagaatctaaggaagtcatatcttttctatcccactgcctttaggctgaattttcattgtagtcaaaactgtactttttcattccttccttgcttccttcctttttttttttttttttggacagtatcttactctgtcacccaggctggagtgcagtggcccgatcacagctcactgcagcctccacctcccagggctcaggtgatcctcccgcctcagcctcctgagtagctgggactactttgtagagacagggtttcaccatgttgcccaggctgaaaactgcacttttcttaattttgttaggttcagtgaaacaactcctgctcaaacaactggattcaaaaagtgatgttcagtagatggcatctttggaaacaggcatgatgacccatgaagtgtacacgcttgggttactgcagagaaggtgctgttacttgtagaaatctgtctttgcttttctaggtggtagcattggtaaccttcctggaatggtgatgaggagaatggaaacaccaccttctagccatagcataactggtcgtggaagttatggaataactggaagaagaatccagattttcttaaaattaaaataagtgtaatttatacaactaaaatctgctttaaaatgtgtcatcctttgtcagtattttctgtggagaaaactgttttccttttactgtgagatatttaacctgtgtaatctcctgtaatcttttcttgataattttattttagcaattattactcgttttaatgctttgaaggctcaattcatatttttttgcgtgtgaattacttgcaatcagttcacattttcaaggtatataattttaaatctgatctattgcataaggaaaaaggaaaacgaaacatgtaaactgcagctattctaaagaagtgtttataatcagttccttatgcgtgaattcataaattttcaatgatatgttaaaattgagagagagcctggatagctccttcggtagagcatcatcagacttttaatgtgagggtccagggttcaagttcctgtttgggcgtgtcctgtggcttttagcacctaattctgactctatctttgaaaaagccaaaaaaaaaaaagtatgatttgggccaggtgtggtggctcatgcctgtaatcccagcactttgggaggccgaggtgggcagatcacttgaggccaggagttcaagaccagcctggccaacatggcagaacccaatctctactaaaaatacaaaaattaaccaggtatggtggtgtacacctatagtcccagctactcgggaggctgaggcccaagaatcacttgaacctggggaggttgagctgagctgagatcacaccactgcactccagcctgggtgacagagcaaaactctgtctcaaaaaagaaaagtaaaagaaaattgagaacattgaatactgaagaaaacattggaagattgtataactactttatgaaaaaaattactattaataataatttaaagacattcttgttttgtcattcatggaaaccaatattgaatgagaatgtgataaagaaaattcaagttgtaatacatctattggattcctttgaattctttcatttttaggaagctgcacaagccttaatttatgctgagatggcaggatcaagcctagaaaatattcaagaaaaaataactgagtatctggaaagagttcaagctctacattcagcaggttagtaaaggactactaaacttgtcactctattttttcttttctcccatcatgtctttcccccatgtttgtttctcttcttcatttttatctttgaatcttgatgctcactctgttgctgctcattccacttttggtaatcacctctttaaaagtcatttagaaataagtcatagatctttgaagaggaaccttatagacaatatagtccagtttcctaatttcccagagtgcagagatggtgaattacctatgttcaaacaatttatcattggcaaagttaggattaggattcagttaaagtctgcttttaaaatatctgtcacgtctcttccttataaaattaagtgactgttcctcttcagtgtttacagacttcagcagtaggttcacagtgtcttctctttcggtgtcttctactttcagacctttgctaaactctttaaaaccatatcttgggaaagtgacatgtaaacagagacttggaactacttgtatttatttttgtaaacagcacaacaggtacaataatagaaatatatagtcttaatggtcacagttttgttagaggtaactgatgttgacattgtatttacaaatacattgatttctgtagggattctttttaaccctctttttctgttgctgcatgataaagcgccaagcagaagaatatttattctcatggactttgtgtaactttctaccactcattttgagtagatacgagcaattacaagaacatcgttgggataaagtagatttaatcattggattccttgttatgacagttcccttaaaaacaaggcggtttacttttaatacagtgcccagaaattgcatgtattgaaaagtgtactgcctgtgttattggaacctcacttgatacaaagtattgattcatgtattcaaaatatcatataaaattcaaaggaactttcttttcccagccaagtaaatgaagttcttaaatttaactgcccaatattaggaactttgtttcataaccagtgttttcaaataaaattatctttgaagtagggaaggtagtctttcatgtttacttccatgatctccttgttttttcatagatagttttcttcatttcaataactatgtattgaatacatgtttgggctctatggtaagtacagggtaatagatgagtgacagtccatgtcctcaggaggacttcatcaggtgtggagagagaacagtgtcaacattgcactatcatggaaacccctttctgaagcatgctagactaaatgttaaagcagaatgctctagaaaggagagattatatggtgatattattccaggagtagaatctctggcagcctaaggtatatttccatctttcttttccatatgtacacacagtcaagcacatttatgccctagggtcttgattccagtaagattgctctttaaacccttgaaatccttgtgacaattggaaaaaataaatatgaatcatttttttctaaggaattttaaaaattattcttactttatattaaatacagctaagcctaaaaacttacatgtgatttttgggaaataaattctaaacattgatatatatgtgatattcaagcatcaaatgagacaccccaatctcttgaagaataaagacttgccagtgaaatagagttcaaaaaggattttttttttttttttttgaggtggagtctcgttctgtcttccaggctggagtgcagtggcgcgatctcagctcactgccaagttccgcctccggggttcacgccattctcctgcgtcagcctccccagtagctgagactacaggcgcctgccaccacacccagctgattttttatatttttagtagagacaggatttcaccatgttagccaggatggtctcgatctcctgacctcgtgatccacccgcctcggcctcccaaagtgctgggattacaggcgtgagccaccatgcctggccttaaaaaggatttttaaagcataacatagcttgttttaccaacttctttctgcttttgttgaagaaatggagtataatctctagacaatttaaaggattttcttatttattattttaagcagaaaagtcctttttcaaataaaaatcctgttaggaaccctaagttttaaaacaagatagtctgctgacagttaagagaatcctgagagagagttgattttggggtggggaaaggtaacataatttaaaattaaccagtataggccggcacagtggctcatgcctgtaatcccagcactttgggaagctgaggcaggagaatcccttgaatctaggagttcaagatcagcctaggcaacatagacttcacccctacaaaaattgaaaaaatttgctgggcatggtggtgtgtgcctgtagtcccagctcctcagaggttgaggcaggaagattgcttgagcccaggaggttgaggctgcactgacccgtgattacaccactgccctcagcctggatgacagagtaagaccctgtctcgaaaaataaaaagtaaaattaaccgtcgtagtacagagttcaagacttggaattaaaagatccctgttgagtctctaccctttcacttgtagctgtgaaatcttagactagatcaatgggtctcagtagaaagcaatttgccccccaggggacatttggcaatttctggagaagtttttggttttcacgctgctgggtggcaaggaatatgcttctgggatttagctgggtagaggccaaggctgttgctaaaaagtctcccacaacaaagaattatccagcccaaaatgtcaataatgccaggctgagaaacactgggctagatatttcaacatttttgagctttggtatctttttcatcaatggaattagtatatacttcagagaggcatttaagaaggctaaagttttgaaaacatcagcacaaactgggcacagtggtgagtgcctgtagttccagccacttgggaggctaaggcagaagggtcacttgagcccagtagtttaagagtttaaggccagcctgggcaacctagtgagaccgtgtatttaaaaaaaaaccaaaaacacgtaactttaaagaactaacaaaatctcagacttttcttaaatagcaagtttagcgagatacaatttccatatcataaaattcaccctcttaaagtatataattcaggtgtttttagcctattcccagagttgtgcagtcatccccactatctaattttagaaagttttcatcaccccaagagaaacctcttacccattagcagtcaatccccattcctccctccccctagccaccactaatcttgttgtttctatggatttgcctattgtggatatttcatacaaatggaatcatccaaaacatggcccttttgccatgtggcttctttcactgagtttaatgtttgcaagatttttccatgttgtagattgtatcaatacttcattgctttttatggctgagtaatatttcattgtattgatgtgctgcattttgtttatccgttcattagtttttggagacatttgggttgtttacaccttttggctgttataaataatgcagttaagaacattcatgtacacgcagtggctcatgcctgtaatcccagcactttgggaggccaaggcagacagatcacttgaggccagcagtttgagactagcctggccaacagggtgaaaccccgtctctactaaaaatacaaaaattagccaagcgtgatggtgcacacatgtagtcccagctacttgggaggctgaggcacaagaattgcttgaaaacccaggaagtggaggttgcagtgagctgagatcgcaccactgcactccaacttgggtgacagggtgagattctgtctcaaaaaaaaaaaattcatgtacagatttttgcatagacatgttttctcaattctcttggaattccacccagaagtggaactgctgtgtcataggatgtagctccatgtttaactttttgaggaactgccaaattgttttccagagtggctacatcatttcacagttccatcagcagtgtatctgggttccaagtccttcacatcctaacacttgttattgtctttctgattttagccatcctagtgggcataaggtgtcatctcattgtggttgtgttttgcattttttgatggctaacgttcagcaatttcttatgtgccatttgaccttttgaatgccatctttggagaaatgtctgttcagatcctttgcccattttttaactgggttgtctttattgttgaattttaagagatctttatatattctggatacatgtttcttatagatacgtatttttttattaaaatcaaatgaaaatattatttcaaagagcaatgaaaatacataacatattctaggctcagggtaaatagaaaaagcaggaactttatcatcagagcctagtatattacacaattttgtctgtgcagaaaaaaaagttttaattgccttaaaatagatttcttaatatttagcaatttccaagtttttgttttgtcttttgaggtagaggagcatatgaggagaatgcctgtgtttcaatttttaagtgaagaaagtgccagtgggagagagaaattcagggaaagaattttttaaataagtagtgtattttttactattctttatctctgatgtctattgtgtggtaaataattgcagattttttttcttagaccttaagattaaaaagagaagggaggaaggctgggcatggtggctcacacctgtaatcccatcactttgggaggctgaaactggcagattgcttgagcctgggagttcaagaccagcctgggcaacatggcaaaaccccatctctacaaaaaaaaaaaaagagagaaaaattagccaggcatggtggtacactcctgtagtcccagctactcaggaggctgaggtgggagaatctcttgagcccgaggaggtagaggctgcagtcagctgtgattgtgccactgcactctagcctgggtaacagagcaagagcctgtctaaaaaaaaaaaaagaagggaggaaatttgtccttttttaaggatttttttaaccttgctaagttttttaaatgaagaatacagggttttggtaaaaaatgtcttaaatagtgaaaatagtgtgttttctggctgtatttagataatactccttctgcgtatttttttttctatcctagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacagtgtgtatagctacaaattacgtttgatgagttatgccaaaccatttcttctcttgctagtgaattttacataacaccttgaataaaagaattttaacagaataaaaaaaattattttaaatgtaacaactactcctcaatataagatgatgagtagaaagctaataatgggtttttgcatcttattaaaattttgaaagtattgagtcttaaattacaagaactatttttaacatttctgttcttacaactaaaataaacttacagaattcattatcacaaatctattaatttagaataaacttccccttttttcagtttcgtgcactaaaaaataagctagtggtttggatgagccttacttatttgcagtgtaaaatctgtatgctgagtggcttttactgctccctgctgagccttggttgggactcttagcttcaagggacatctagtgcataagagagcagtgtatttgacaggaggatgaggtaaagtagttgagactggtatccccatgtctttctgactggctttttggcagagacttttgctcagagagaccatctggcctgatttctgtaggtgccttgagactaaatgagtgctagtgttctgaggttcctgccactcagcgttccacagcactatggtcaaacagttctggtccagttatcagttgtccacataagtggttttaaagtgcacctcagtgacaaattttcaacactattttaaatgatacctttaaggatgagaattaatgtcatctttgtttgttctcaatttcagcaagtgtaatatgcattgtaaattttttgcttagaaatatggatcaagcaaattgaaaaataattatgctttaaaatgtctgtctctttctttctcttaagtcttatgaaactgctgataaagtcctgcaaaataaactgaaacagttggctcgacaggcactagacaggtgagtttgatctctcaagttctaatccatggatggcacttagtgttatttaaacaaatttatctaaatgtgttgtaaaggctgcagtaacaaacctccatcttttaactgtcatctgaaacaaatctactttctacttcttagtgaatttacctcctctctctagttccctgctttaaactcaagaaatagcaaatcaataaatgtttttaattttagtttagaacagaaaggactgtgatatttgcaatggaggacctcctttctgttatgtaatatcagactttcaaagagaacttccagagagccttccagatctgctaaaaatagaaaacatgagcatgaacttgctttcagccatgtacatacctcagattatacagtgtgtagctctttcacctcttagctgaaatgtcaacttttcaatgaagcctgccctaaccattgtttaaaattgaatctcccccagcagttgcaacctgattattctggtatttttcccacagctcttattttctgaggtctgtgagatttactagcttattatatttgttgttaatgtctgtgtcccctccaaccttcatcccccagatgtaagctctgagggcagagatttttgtctattttatttagtgctgtaaccaagtacccagcagagtgcctgacatgtaatatgtgctcagtagatatttgctaaaagaatgaatgagtttgcataagcgaattatatatcttgaaagagtgttgtagacacacaaaaaatgaaagggtggaaattgcttttatacctacatcatgaattatctccttttgaggctctgacctgatagataactgtaccaccccaagcccttctttttttaactgaagtaaaatagtcatccctccttttcattgtcatctactaactttagtttgtttcctcagattcacaaagatacgagtccttgacatacagttgtcttctctatcttgacttctttcacctgtcagaattataagtgactttattacgtctgtggctaacccatccaatattctcaagtgcaccctaagcaaagggtgggtgagatagccatgggctcctatgaggatcttttgaaacttatggatccattctctaggaaaatgtacatgaaatttttttgcatataatttcagagttttcacaagaatcctgaagctcatatatgcacctcaggttaagaacttctattttttagctcgttagttctttgacagaacaaagttaaaattctgttgcatatcatgtgaggctgtctgtgatccagcccctgctttcctctctagtctcatctcctgctgcctctcgtttgcacttctcacaggggcaacattcattcttttgcaattacctggccgggcacggtggctcacgcctgtaatcccaacactttgggagactgaggtggacgaatcacctgaggtcaggagttcgagaccagcctggccaacgtggcgaaaccctgtctctactaaaaatacaaaaattagccaggcgtggtggtaggcacctataatcccagctactcagaaggctgaggcaggagaatcgcttgactcggaaggcagaggttgcagtgagccaagattgcgccactacgctctagcttgggcaacagagtgaaacgccgtctcaaaaaaaaaaataaaaaatttaaaaaagaaattaccttaattcattgtgctgtttcatacttctgcacgtttgtacatgttcttctgtctacttagaatgcttcctcactgcccaggtgaacaactctgcagctcaagcatcagttcagagcacccttctccaactcatccccacttggcaattcattaagtgaataacttctgttgtacattcatttgcatgtaatactttcatcctagtatctgttatttttgatgcagttgtctgtctttccctacaaaactatgagtaccttaagggtagggattgttttatacgttcttttataccacttaccttaccttgtatggtgtctgattatgtaagtgcttaattaatgttgtcaatagaatattgtttgtaaaagatgcttatctttggaagtagctgaagtagtgaaatgttgattagtatgtaagaattttatatactaattttacattagggatgcttgactggttcttcaagtaaattttgtttcctgaaaagcttaaatgtgagtagaaaaactagaacagttgtttgttcctctctgttatagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggtaaataagtttacaattaattgtaatgaagaattttgttaacatgaatgcagaattttattttcattaggtttgctgaattgtattcagatttctcctatagtgtattgtgctgttattatgtaattatatcatcatgtagtcacaacttgaaatagttaaaattttagttctgatatattttattttattttattattttcatttgtattttttgagacagagtgtcactctgttgttcaggctggagtgcagtggtgtgatcttggctcactgcaacctctgcctcctgggctcaagcgattttcctgcctcagcctcccaagtagctgggactacaggtgtgtgccaccacatctgactaattttttttttttttttttttttttttagtagagacagggtttcataatgttggccaggctggtctcgagctcctgacctcaggtgattcgcccacctcggcctcccaaagtattgggattacaggcatgagccactgtgcccggctttagttccagtatattttaatattagcgtttttgctagacataatacactttgctgaaaatcctagcattctgtgaaactgagccactaaaggttaaggagcaaaatgagctgtagcagaccactcttaatctatgcaactttgtaaccagagccctaatgggagaaaaaatgttactttgaaataggagtgtaggtggtgtgctggcagctcacccctgcaatcccagcattttgggaggcagaggggggcagatcacttgagctcaggagtttgagaccagcctgggcaacatgccaaaaccccatctctactacaaatacaaaaaatagctgggtatgatgatgtgcactgtaatcccagctacttgggaggatcacttgagcccaggaggtggaggttgcaaagccgagatcacgccactgctctccagcttgggcaacagagggagatcccgtctcaaaaaaaaaaatatgtgtgtatacacgtgtatatacatacgtatacatatacgtatatagtatacgtatacgtatatatatatgtaaagtttttctttgaaaggttttacatgcatcaaaaaaaaaaaaaaagaatatatgacagaaacctcattgcaaagcctaagctatataccatatggctctttacagaaaacatttgccgaccccctgtctagcgggggttatagcgtgtctgaaagcagtctcagaggatattaaaaatgtaaaacacggctactctgggcacactgcctatggagtagccctgttccacaaggagctgtaccaaaaaaaaatgaaatgtgaaacacaataatgtggaaattcttgattgccctctgaaccagtgtagctaggataagtccctgagccagacagggtggcttttttaaagttgagcactgcagaaagttcagtctgcttagagctgtgtaagtcatgtaggtgttcatctttttattttctaaaattgagctgaaagggcttctgcctaggtagcagccatctgagagcatttttctttcctttcctgctgaagattgtaattgtactcctgctaatctggctccctttgtctaggaaaaattgcatgtgcaccaacacagcacaatacaggacaaagaagggtagttttgaagctaaaagactaataacagtccaacacttttccatatgctaccttcacatgtttgaaattctgtactacaccagaacaactctatattccacctaacaaaatgcagctatccttcatgcgagtgaaaagttttcattatctttccaaaataaggctgtacatagtcccaacaatcatttcatctattcctgactatattaagtagtcctcagatttccaggctattgttacctaaagactaaattctgaagttactctgcaacatctcataaatagaataagggagagaaacagatacaagaaggaaatagttaatatagataaataagcatatacacaaaacaaggagaatgcaaagctactacaaaccttatttctttaatttgtcagtagaccatagctgatatctatgacacttccttcttccactacccatttcatgtcctcataaccagaaaacgtgaagagcatgtatttcagaattgttaatgtgtttttttaattccaaaataacttaagcaattgatttctccctttaggcttagcatagaattggttttgtgtcttggtgtcaaggacactttcattacctcttgaatagtcttgtcttcttgtgggtgttagcctttaaagaatattcttattggtttgaattgattcagttattttctgattttcaattattttatgaaaatattgtccaaagatatatcaacaacatgaggttgtcagtttaattttaatacagtatcataccttgtcatttaaattttaaagagttgaaataagattggcaattaaggtaaacttgaacatttaggtttttttctcgtgtttgataggacaacatcaaaaataaatggtatagaatatgttcctttcatgaatgttgacctgagagaacgttttgcctatccaatgcctttctggtaagtaagcactgttgcaatttttaactccaatattttaacttttcagtactctgaagttcaatttaatagccttgaaattaaaatttgtaataaaaaaatttgttggaatagaggggtggctgtgggaaagggatagggcaacatagcaagagcacttttgttatttgcccagtcatgaggacatgaggatctccttttgcctaatattatttctgtagtgtctagcacagtacctggtgtaaagtaagtactccgtaaatatttgtccaagcagtgattgaatcacaacagaaattctaacacacagtaaagaaactgaatggaaaaggggaatggaatgatgtcattgtttactaagaagaccaattcaagcaaggactatttatgagagaattagttagcacagccttccaggacaatggcagcttatgtcaagagctttaaaaatattgtttggttcaggagtccgagcttgtagtcatcgtaaggaaatcaacagtcaaagatgtacataataaggacactcatcaaagcatctgttgcagcaaaaaattattgaaacaaactggcaatatgggaatgattaaataatagtacatctatacagtcaaatattatgctactcaaaataagtatttaaaactgtaggaaaaaaaatgttcccattacagaaatcaaaaagaaaattatgatgtcccaaattttttttttttttctttttttttgagatagggtctcactcccattgcctaggctggagtgcaatgatgtgatcatgactcactgcagccttgacttctcaggctcaggtgattctcccacctcagcctcttgtatagctgggaccgcaggcatgcaccatcacgcccagctaatttttgtatttttggtagagacgagattttaccattttggccaggctggtcttgcactcctgacttcaagtgatccatctgcctcagcctcccgaagtgctgggattacagatgtgagccactgtgcctgacccttctttttcttttcatgtatttatagatgcatagaaaaaaaaaatgatgtggagaaatatacccgaatatttacagtggttatgtctaggtaacaaaattttgtgatttaacctctttcagtacttttttatttttcaaaatttctccaatgagcatgttatatttattattagaaaaaaaaagctggatgcttactatatagaatatgaaggctctgtaaagaacaaaagggctgctttttattttctagtgttttgctgttcttttgccaagggttaggtatcacaaagccagttaacatatttttttcactcaggtagctgtgtgatgctagtaactgattgggaccaaaggaatttttatatctgagaaactttatagcattaatgttcagggaaagattctagagccagactttctggtctcaaaccttgtgtaacaccgggcaagttgttaaatctgtctcagtttcttgtctgtaaaatggggataataatagaaactacctcataatgttactgtgagttaataaaatgtaaaaccctgagaatggtgctgttatatagcaagcactatataataaaggttacctgctagaaaaatcatcattttgttagttactaagttatataacaatttggctgtatattccaaatactttaacattttttatacctctttgactaatgattttacttcaggaatccagttgtaaggaactatttagagatatactcaaaaattcgtacgaaagcgatttatcattgttgttataattgtgaaaatgaatcagttattctggtattttcttgacaatattcaaatagagatgtaaacttatcatttctatctttttgcaacaaattaatgtaaatcatatttgttatgcttatacgacacagtgtccataagaaaaatgttatatagccataaacaatcaagttttcaaggaatgtaataacatgggaaaatgctcataatataattggaaaagtaaaatacgtagccatgcagactcccttaatttaggcatagcacttgtcacagttggaatttttcttttttttctctttaaggtgattacttgcttaatgcttgtctgctactctagcatataaacttcataaggacagagaccatgtctgttttaattaagttgcaccccagtgcctaccacagtatctggtgtatagtaggtattcaataaatatttcttgaagtagttaaattgggagaaaaacaagaataaatactaaagttactattctaagtggcacggtattttcttattttttaaattattttactttaggaacaatcagaagaaaaagcaacagtaaatgtttttaagttgggttaacagatcatcaggaaaaggctccagaatttatctttcgctagagagattgaattattttttaaaattgtttctattcggtcgtgtattacttttaaaataataaaataagcattattgaataaatattataattgtaagtttttttattttttattttttgagatggagtctcactctgtcactcaggctagagtgcagtggtgcgatctcagctcactgcaacctccgtctcccagattcaagagattcttctgcctcagcctcccaaggaactgggattacaggcgcccaccacacgcccgactaattttgtattttgggtagagactgggtttcaccatgttgtctaggctggtctcaaactcctgacctcaagtgatccgcccgcctcagcctcccaaagtgctgggattacaggcatgagccaccgcgcctggctgtaaaatatttttaatatatttaagttctgagggaaaaaaccttgaatttaataatcctctagtgacttgagagaacaaatattatggaatcttggatttatgctgaaatatggttcatatgacaggttaataatagattacgaatttgaatttgcattaattttttctcctcaaaatttttgagagctgtctttaaactcttctgaattcaattagctcactttctgtttacagttagctcctggtattatacaggtaccaaaatgctacctggaatactagtggttctgtgagatgataataaaaaatgtttgagatatgttatatgccatattctattttaagagattgcaataaacattggcttatttaaagtctagaggtgtccttcaatgaaaaaactaatactttaaccaggagtttgtagatcatacttgaccacaaaatcctctcttctcccagtatctgtcagcattctttgaaaaaaaaaaaagttatgtttgtgccagtttgcatattatatactttctattactaggaaatcttttgaaaaccaaggatttgttgcttctgctctagaaagggtttggggatggttgggcctggtggcttgtgtctgtaataccagcactctggtatttacttcaggaaggctggtatcagccttggctggaggatcgtttaagcacagaggttctagagcagcctgggcaacatatggagacctcaactgttaaaaaaaaaaaaaaaaaagtttagggaaagggggaaaggtagatgtttccccttggtgtacacatcaattttagagaaacattgttacacacagtgagtagagggtaatggataagaatggtggatttggcaccagagacctggattcagatgccagttctgctgtttcttaggtgtctgaccttggtaagtcattaatcactttaagctatttccaaaaataattcctttaatagagttgttttaagaattaagtggattatgtatgtaaagcactttagcatgatgcctggcacatggttagtattcactaaattagctacactcattattagccttgccaagtggagtttgtaaaaaaccagctttgaatctttagcttcctaggtccttttgaatgaatcagcttgtactattgttaatggtttcattttattgctgaatttcttgaatacagttatgctaaatttaaaaaattatattcttaaatataaatgaatttaagttgttcttctgttttcaattatttaggtatattttttaattggaggggatgatcaggttgactggactctataaagagccagatttgaccagaaggttattttaagataatacagtactgctataatcactagaccaaaaaaaaaatctctaggaaatttaattttggctttgagtcatcttttaagattaatttttttattttaatttttattattacctcagtgatagatggggcaagctaccattatcacctaaacaaaaaactacattttccaagtgggtacgaccagaagacctcaccaacaatcctacaatgatatatactgtgtccagttttagcataaagcaggtgagcatttattttgtatgattttatagaaaagtcagcattttaaagtaatttgtgtatagatttgagttttttcttagattttttattatatattcaggtacagaagtgtaattggaaaaattgttcattctacacattttgactgaaacatactgagataatataagtataaatcactgttttgagtgattacagatttttatgtgggccctgtttatcattatgtacctgtaaatgtaaaacttgagaatctgaatttcacctttgataaaggaatagatatcagcaatagaaggatatttaattatttgagtaattattcaaaatcaatttttttgaaatacattatttaattttctaggatttattagaataaaatgtgtgagtcagcagtatggtgtttctatttgttactttcctattcaaataataaccaggaaaatatttagtatacattgtagcactattcaaaataacaaagacatggaatcaacctaaatgcccatcagtgacagattggatgaagaaaatgtggtacataaacaccttggaatactatgcagccataagagaacgagatgtcttttgtaggaacatggatggagctggaggccattatccttagcaaactgacgcagaacagaaaaccaaatactgcatgttctcactgataagtgggagctaaatgatgagaacagcttaaaagaaaggaacagcagacactgggttctacttgagcgtggaggataggaggagggagaggagcggaaaaaataactattgggtactgggctaatagctgggtgttgaaataatatgtacaacaaacacctgtgacacgagttcacctatgttaccttccacatgtacccccgaacctaaaatagaagttttaagaaaagatatttagtataaaaagtaggtacttggggcaatgtacgtatattgcggtaatgttgaaattacgtgaatgaatatgaatatgttaattattcttattaacagacaatagtatcggattgctcctttgtggcatcactggccatcagtgcagcttatgaaagacgttttaataagaagttaattaccgggtaaaaatgtgtctctctttacctctttttgtgtaattgtcccttaactagaaatttaaaacttaagccttatctgtatagaaagtggagagggcatatcattcagaatatggcccttctgtagaaattaagcagatgatttatgaatgtggaaagatacgctaaaacagtcttaagaacctatacacgtagttaatatatatgaaattaatgtgttttgaaataaatgaaattgatcaaagtaaaatcatgtcatattgataatactttatgattggactgttaagtgaggtagtcactagccacatgtggctatagacacttgaaatggattagtctgaattaagaggagatgcactgcaagtgtaaaatgcatgagattttgaaaacttagaacataaaaaatgcaaaattgcaaaatatctcatttttgtgttgattatatgttaaaatcatatttcgatttgtgattaaaacatcaaaattggttttactttttttcttttttttttttttttttttttttttttggagacaaagaatttcgctcttgttgcccaggctggagtgcaatggcgtgatctcggctcaccacaacctctgcctcctgggttcaagcgattctcctgcctcagcctctgaagtagctgggattacaggcagttttacctttttaacttttaatgtggttactgggaaatataacatatttctgttggcttgaactgctttagaatgtattaaaatgtttctgaaatactttttcagtttttaaaagatacattagcttaaaatcattcattgcaaaaactaagcattataattttttcaacttttcctgagcggtttttgtgtgttaagtcctaagagtataaagatgaattagacgcagtccttagtttcaactatttgccatataagtggtccaaatgtattttaaaagaaaattgatactgatagttgttgaagtatgttactgtataatttcatgcaactatatgtcaaagttgtatctacttgccttagttgtggttaattggtctttacttcttagggccagtggtaaaagattattttaactggcttaaaatatatacacttaatagatggtttattagggtatgtaagttaacattgagcacttttcagagtattttgaaatttatgtccactttgtgatctcagaaaattacttactaatagtaaataagcactttgattagggtgtagttcattttctaggcctattgtaggaaaatattctcctgtttgtttttatgaaattgccaagacggtagtatatacctgaatgaaatgtgctgtatagtagttgatattgaatactaatgttggtattttaatatttatttttcttacaaaagcataatttaccctcaaaacaaggatggtgaaccagaatacaatccatgtgggaagtatatggtaaaacttcacctcaatggtgtcccaagaaaggtgaataatgtctctccccactcccatcccttgtctctctccgttccctacctttgaatcttgagtgaaatcattaagaaatgtcatctgtttgaacattttaaaagttagagtctgtgatattatatattactaccagtagcatcatgtgttaatcattaaaaattaattaaaaccatggcaagtataaacttgttttttaaatggttttgagaaaatgtatacagtttcaaaaagtaacgttcaactaaggattgctaatgcttaaaataaattttcatctgatagttcatctgattgttttgattaaaaggaaatcagacaaactaaatctgttaggtcagaagagtgtatatgtagtcataacttaagtgtaagaagcctttgaaattatttccttttaaatatatatgcataattttaattcacacaaatttctttaaggaaagactctgaactctgttataagggccttgcattgttaaggttctccaccacctgtccatgttgagatccatgcagcaacatcagcatcacctggaagtttgttagttttgcagaatttcaggcttcaccctagacctgctgaatcagaatctgcgtttcacctagatcccctgtgatccagcctgaaaatcattgctctgtagttcagtaatactcaaattttagtatgcacagaatcacctggcaggtgattatctgttattaaaacacaggtttctggacctcacgcccagagtttctgattctggaggtctgagatgagatcaaaatttgcatttctaacaagattccaggtgatgctgatgttgttgtctagaatactctctgagagccattttacctgatttacttaaaaagtaaagaaaattattgagaataattttactgaactataattcttgacctcttgtttaaagaatctttaaagatgtatggcataatcttcctattggtgttaaatcaaaattcttatcctcatatctctgagaacactttttttttttttgagatggagtctcactctgtcacccaggctggagtgcaatggcacaatctcggctcactgcaacctccgcctcctgggtgcaagtgggtctcctgcctcagcctcccgagtagctgggattacaggcacccaccaccacgcccggctaatttttgtatttttagtggagacagagtttcaccgtgttagccaggatggtctcgatctcctgacctcatgatcctcccgcctcggcctcctaaagtgctgggattacaggcgtgagccaccgcgcccagcctcagatcactttttaatatgaattagatactgtatctgatgacttcctctgttatttatatgtattttctagccataatgttctactcttacaactatacatgagtctttttataggtttagaataaaatgacaataatactgcatttaaaagtgaggcccttttgtaattattttaaatgtacatttctagaataatataggttgagtatcccttatccgaaatacttgggaccagaagtgttttggattttggattttaacagattttttaatatttgcagaatacctacaagttgaacatctctaatctgaaaatccaaaacactccagtaagtatttcctttgagcatcatgtcagtgatcaagaagtcttggattttggagcatttcaaattttagattttttatttcagatgctcagccttttaatttcagtgatagttacatgacatttaatcaattgattgaaggttatcatctgacagattagcttgtaaaattgaataaagacatcatattaaaaagaacaacattttgtaattggtatgattctagaaacattaccttaatagccgtcagcatattgtgcgttatattttatcagtatgaaaggtatgtttttatttcttgatagaaaggattttaagatattttgtgcacctaagaaggttaatgttctctttctccaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccgtaagtaatagataagacgatccagacacagatttaagctatctaatataactgttttaaatttgaaaaattctagatagtctttttgtttatagggaaagagagcagattatcaacccctgaaacaggatgaccagtccccgtattatggggatatatatattttcttgtgtatccgggaaagcctaaactgtgtctgcttttgttgggatacaaggccaattataaatacagtgtacatttccagagcagtctgtttagatcaaatggatgtgtcatattgtcatgtatttttttatttgtaattcaggttcaaggagttacttgttttatccagtcttaacagaacttaacctataagattgaggtgtcttccagtgaccttttgttgcatgaggtaaactagacttgagccagaaagaaattagtcagattggcatgactttaaattcttacaataaccagcctgtggccttagaaaatgtgtttaacctttcttagcctcttcatgtatccataatataaggataatatccacctcttgtcttaaagtcgtaaagatgaaaattgcatctttattccaataataaaatgaagtgacatatgcaaatcacccatcattcataagtgattagtttccctgccaaaccaggtgtccttgacttttccagttttatgcccagttctaatgctaggcaaagaatatataggtcataattaaatgcaataggatgttacagtttttcttttcccagcctatactttcaattgctctatccttcacatacttttagtttagctttctaattgttgcttgttaatttactcagtggagtttagagagagaaagaatgggaatgtatgtaaaacatgaggaacatcattgcaagaactcactaaaggacttgtgactgcatcgttgaagcagttttttctgttacatgtctttttatcatattcacctgtaaaaaatagttttttattcaggaaaagcaacaaagattgtagggaaaaatatgcatgttcaaattcagttaggaatttgagttaaataagaaatatattactagttgaaaacaactaccttctgatttatttctaccaaaatcattatgccaaatcagtgagatgtaatagctgctctggggatttaagaacttgaaaatgacactggcagtcctgaaatgtgtttctgttgcagaatattgatcttcatgcactgactggctggataccagaaagaattgctatgcattcagatagccaaactttcagtaaggataattctttcagaatgctttatcaaaggtaaacatttttctttgttttatgtgtgtggtaaatgtggccgtttaaaaacatcatgctggctgggcgtggtgggtcatgcctgtaatcccagcactatgggaggccaaggcaggcagatgacctgagtttgggagttggaggaccagcctgaccaacatggagaaaccccatctctactaaaaatacaaaattagccggatgtggtggcaggcacctgtaatcccagctactcaggaggctgaggcaggagaatcgcttgaacgcaggaggcagaggttgtggtgagccgagattgcaccattgcactccagcctgggcaacaagagcaaaactccatctcaaaaataaataaataaaaatttaaaaaataaaaacatcatgcctgatttagaatagagattgcagaagttgtcgtttttagttattaaggaaattgtttttaaaatagacttcacattatgtacttcctatagccagtcctcagttatcttcccttaatagttacagttaatccaaattgtagataatccaaaatattagaatatgtaatatagaaaaattattttagatttactaattagttaccaagttgagggaaagtgggaaaagagaagtctgagaagttaagccttaaatggataatccatatccatttaagggactggaagtttgtctaaacagtgatacacattcggttgcaaaactagaaagctcagtgatttgataaataaaatgatatgcctgtttgggaaatgcctgtggtatttcacgtctttatttttatttgtaaaccacttgaaatttagcgtttgttttccttctttggtaggtttctggtttagaattaagttgccagaaacttaaaaaaagagaaatgtgataatttattttatatactgtgcattagaaatgtacttctttttgaaaattcttcaggggtaggaacagcccattttcatgtaagccattagactaaaagataaaatggtgtgatcttagattacaaatgtgttttactttaattaattgtctttggggttcattccagatttcacaaaggagatgtcctcatcactgcgtcaactggaatgatgacagaagctgaaggagagaagtggggtctggttcccacacacgcatatgctgttttggatattagagagttcaaggttttgccttaaatctttttcttttatttttcttgttggataagacatttcagggatcccagataatttatcagacttctgaatactgacaaatcaaggtttaagtggagtttataaaccatttcacctacattaacttgatctctaccgttgaaaattatgaaattaaaaggtgggaaaggaaatcatagggatggcacagatactgatgacagaacagaaatgctgttacacctctttgtcttttccataaaaccagcagttttgaggcggaatacatagcttccaagattccaagcttcttcttcgtgtttggatcaatcacagtgttaagctctaaagcagtggtcgccaacctttttggcatcagggatccgttttgtggaagacagtttttccacagactggggggtgggtgggagcatggtttcaggataaaactgttttacctcagatcatcaggcattagattctcataaggggaacacagcttagatcttttgcatgcacagttcacaatagggttcacactcctatgagaatctaatgccaccactgatctgacagggggcagagctcaggctgtaatgctcacttgcccactgctcacctcctgctatgcggcccagttcctaacaggccatggaccagtacctgtctgtggcccgggggttggggacccctgctctaaagcatagtagacactgaataaatacttatgaaagtgggccaggcatggtggctcacatttataatcccgatactttgggaagctgatgcagaaggatctcttgaggccaggagttcgaggccaggagttcaaaaccagcctgggcaacatagtaagaccccaccgctacaaaaaataaaaaaaaattagctgggcatggtgccatatatctataattccagctactcaagaggctgaggtgggaagattgcttgagcacagaagatcaaggctgcattgagccatgatcacaccactgtgcttcagcctgagtgatagagaccctgtctgaaaaaataaaaaattgtgaaaggggaagaaaataggaagatagctgggcataagatacatgccagtgtgttttgtgtaagcaagtatttttcttcctagaagcccttgcatgctgtcaggcctttcagacagaccctgtttctgcaatatctggttagaatatttgacttcattacttctgaggttgttgttatttttaactgaaaaatggatttgttctatggattcaaaaataaaaagattattaaacaagtactatttcttaatgaaggacccttgataacagaacgaatagaagtagtgatcagtcagcaataacagagcactactgtgtgttaattagactggttttcttatgtgtggcacatggatttacagtcacgtgttgcttaatgatgagtgtacattctaagaaatgcattgttaggtgattttgttgtggcatgaacatcataaaatgtacttacacaaacctagatggtacagcctactatacacccaagctctgtggtatagcctagtgctcctagactacaaacctgtacagcatgttattgtattgaatactgtaggcagttataacaacttggtatttgtatatctgaacatagaaaaacacagtaaaaatacagtataaaagattttgttaaatggtacacctgtatagggcacttacatggttggagcttgcaggactggaagttgctttgggtgagtgagtgagtggtgagtgaatgggaaagcctaggacattgctgtacactactgtagactttatgaatgctagacatgtagactttataaaaatatttttttcttcaataatgaattgttctaagccagtcaaatcatcagtggtggttgtataccaactttagtgatatgttattaataagttctgattaacccattaccatcggagcagcccaataataaattaaccttggcttactgtaattttttactttataaactttaaattttttttaactttctggctctgtaataacaactagctgaaaacacaaacacattgtagagctgtacacaagtactttacctgagcttttttctgttaatttttttttaggctgttttcttaaaatccgaaacataaacacacacattagcctaggcccacatgggggcaggattatcaggatgtcaattggcaatagaacttttccagctccattataatcttatggaaccactatgatatatgtagttcatcgctgtcttaacatttcattatatggtgcatgactgtatatgaagttaatgaggacagtagggacctattgcaccattttaaaatttatagtcttggaactttctaaattagctggtcagtgttgaaccccccagccatgctctatagaattgcttctttaaaagtggcataaaaattgcccacttaaagcaaaaaatataaaaattatgtgaaattaagtacgccaataagtttggggttttttaaaattataatttgccacaaatgccagtcaaaacattttaagtggctgggcaccgtgggtcacccctataatcctagcactttgggaggctgaggcaggaggaatgcttgaggccacgagttcaagaccagcctgagcaacatagcaagaccccatctctacaataaataattttttaaaaaattagctgggcatggtggcacgtgcctgtagtcccagctaattgggaggctgaggtaggaggatcacttgagcccaatgttgcagtgagctgagatcacaccactgcactccagcctagttgacacagtgacaccctgcctcaaaaaatgtatatttatatataaaggttttctccagtactcttttattgggtatatattcaaggagtttcctaggtgcattatttttattttttattttttgctacttatattttgaagtgtttatttaattctgacttctttttttttttttttttttttttttgagacagtctcactgtgtcgcccaggctggagtgcagtggcgcggtctcagctcattgcaagctccgcctcccaggttcatgccattctcctgcctcagccccccaagtagctgagactacaggcgccccaccaccacgcccggccaattttttatatttttagtagagacagggtttctccacgttagccaggatggtctcgatctcctgacctcatgatccacccaccttggcctcccaaagtgctgggattacaggcgtgagcccccacgcctggccaattctgacttctgttttaaaatatttccatatttgattcaagcatttatctctaggacctcttttttgcagaaagacctaatcttagactctgacagctctgctcagtattacatcattggtgactttcttcacttaaagagattttcaatatttattaatatttgcataaaagtgctatcatttttgtttgactacctctaatctgcttgcatattccaaggtcttcattttagtctcagcgattctctctttgggtcatttttgtgtttttgaggtgatgtttcatagtctactatggagttacatctccagatcagggtgctgacttcagttcagacaggtgttatcatagaatttctgaagctgtccaaggcttttcctttgctgctacttggaaataactttagaaattggatgcttcagcaaaatcaaattttttttttttttttttttttttgttctctagcattccttctttttagagctggttctctacccatccaaacaaaatctacatccatatcttggtgtccttgaatatcactgatgctgggggtctgtctctgaaaagcttagcaacaatttgctctcctttgtgctcctcttttaggaagtgttgagagtcctgaaatgagttaaattttttgaaaagaaaggaattagagttaaatgtcggttgacttatgtgtggtgagacacatacagtgtagaagatactgatgaaagaaactgtattaatgaagcttctagggaatatagcctaagaggaatgagtcttatgtccagaaatcacatacatctacccccagccacaatttgtcaccatttaaaatagcaaaggaatgtgttgttgtggttgtttagatgtcttccaaacagtttgatttatgatatcattagaaaaagtacacaatttcctaaggtgactgcttgcagtaagacaaatattattttggatttaccacctcttttattttcccgaatcaatgtaatcaattctgtagacatgcctggtatttactaagcatttacctttacattctgttccataaatgagtggaaaatctgaaaagggatgatagtgttaccatttcaaggagttgatgattacattggggagacaagatgactacatttgtaggaaacagtataagataggatactatttgttttaaactaatgtaatacagattgctagcactatgaaggttggagaattcaaagtaattaaaagaaagaaattactaaatgctagatactttatgttaattccatttgatcttcacagccatcttctagggacacatcataatcttcattttacatatgagtaaatgaatgttcagagagggtaaatgacccacccaaagaactggaatttggtcccattttattctgaccccaaagtccatgttcctttctcttttcttcactatgtctgtctgcactgagaagaaagggtagctaaagggatcaaagagggcctttcagaaaaagggaacagcatgatcaattgcctttagaggcaaaattgaataaggattttattgcactctgaaaggaaaaactagattagagccaaaggtacatggagtataaatactggaaaataaagtggagccagagtagagtgagctttgaaaaggcagaaaatacttcatgctctaaggcagtactgtctaatagaactcctgcaatgatggaaatgttctgtatctgggctgcccaatgcattagccactatagctactagctacctgtggtcatttaacatttgaaatgtggctgctgtgactaaggaactgatttttgaattttatataattttaacttaactacatgcggtgaaagactgcactattagctctagggagtaggcagccatttacagtttttgatcgatgtatgacctggtgaaagtgttaaaaatattaatttcaagttgatttgaggggaaaagaattgataagtactcagttcatcctctaataagagaactaatatggtaaaaactgttttacaacttaatgttatctcctgtttcttttttatataggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggtaaatatatctttttaattttaataccatttattcttcaaaaaaaaacatgttttaacaagacaaaacatgtgtaactgacttaaatcatttagcattaagatttttttagattaacaaagatattaattttcaggaatattttggatttcctgggatgatctctgccagtattatgatgtgatttatttgagttggaatccaggtctttttaaagaatcaacatgtattcacaggtaactttttgcacattgcagagtatgctttataatagcatccactttcctcacttaaaaacataatggtgccaggcgcagtggctcatgcctgtaatcccagcactttgggaggccgaggtgggtggatcagttgacctcaggagttctagaccaggttgggcaacatggcaaaaccttgtctctacaaaaaatacaaaagttagccaggcattgtggcgcacacttgtagtcccagctactcgggaggctgaggtcagcagatcgctcaagcctgggaggtggaggttgcagtgagccaagatcatgccactgcactccagcccggacaacagagcaagactctgtctcaaaaaaataaataaataacggaatggttaatttaggaagactagcattccatctttttgtcacgcccacagtgactatcttgttaatagttgttttctttccatgcttcctagttatgccaaaaaaatttaaaaacagtaaaacaaaaccaaaaacttggatagcttaattcactttttgaaatagtgttatattttagctctatgagaaatttaattacaaccttctttgttgactttatcttttagtacttgggatgctaagcaaggacctgtgaaagatgcctatagcctggccaacaacccccagtacaaactggaggtgcagtgtccacaggggggtgctgcagtttgggttttgcttagtagacacataacagacaaggtactgatacccttctaatgatatcccatacagaaatttttttaatatagttagaacattgtgaaagacatacgtaaacaccagcctgtttaatttacataggtgccctgagaatagtgttttctcagataaatgaatattttcctctaaggaaatttgtattttataattatacacttaaaatcttgttcaaaagtcatctctgaagaaaagtatgagggagtttgtgcttttcagtgagggtttgggggttgatcgtgtatagtttagatcttaatattaacattgaaatatgctgaagggaatttggaaatgttgaatcattagtcttgattctgtaaaggttaaccataatcttaatagcctccgaatcttaatatacattcatacattgtggtcatctattaaaatgacaatttaattcagaaaaacaatgtttcttatagcactaaatagctgaaaacaatgctcttaaaattagagattttttgtggagagatttagagcatttttttggagagatttaaaaagaaaataaatagcattttgaacccattttctaaccacattggattctttgtgattttaggatgattttgcgaataatcgagaatttatcacaatggttgtatacaagactgatgggaaaaaagtttattacccaggtatgtttagtagcccagcaaacattaaaataaacatacataagattttatttatatgattaagttgaaaaatgacacattttatgtagataatatagagaaataattatgttgatagactaatagaaaccactcaagcagatgggtattcatgctgttctgtgttttgttttgatttgttttaatttggagactccaaggggggatttccatattctcgcacatggctgtcagaattttatttctgaaacttaaatgatgtcttttactctaatcaaatgtattctgtggttttccttgaacttctggataaaatctaagctctttagcatgatatataaggctttttattcccaccttaatctacctgcccccctttatttcatgccccagcttctcacagttgacatagttgctactccagaatacaccatgcccttgttgccttctttcacatggtttcttctctcaagaatctctcctcctgccttattcctttctccctattctgcttaatgcacatagttaaggtccagcctaaataccattccttccactgggcacctgagatatttaacacattgtgttgaaaccactttgctttcacatttttaaaaaatgtgtatcacttagtgagagaaactatcttaaggctctggagaatagtgatgaacaaaacaggattctgctttcatagagtttatgttctagttggggagacagttaataagcaaaatatcaagtactgatacacgtgtaaaaaaaagggttatgtgtgagtgactggttgcttttggtgggtggtcatagaagacctctttgagcagggatgagaagagctatgaataacaaaaaggaaccagtcatgcaaagaaatcaagggaaaagcattacaggcagagggaacagcaagtacaaggaccttacagtgagaaaagatggtgtatttttgggacagagaacaggccaattgcctgggtaggtgtggtatcaaaagaggtcagaaagatttgcagaggtcagatcacatgaggttctgtacaccacaggaagggttcggagagtctttggcttgtcataatcaggaaaatgacatgtcctggctccaaatgaagatgcagctaggctgttggatttttgaatagagttctggggtaagggtagagatacagataggggagtcaggagcatatagatggagtttgaagataggactgcataaatcacctgtgaagagagttgtgggtacagagattaacacccaggatctgacccttggactctcagacaccttgaggttcagcagaggaaaaaggtaccacaaaagaatttgaacagagggcctgatgaaacagtgaggtttcacataacccaagcaaagaacatttttcaagagaaaaagaaaggacagttccatctattgatgtttgagaaatcaaatgagattaggtgagagaagaaactattgtgggaactaaatgataagaacttacgaacacaaagaaggaaacaacacatactgaggtctacttgaagtggggggagggtgggaggagggagaggaatagaaaagataactattgggtcctggcttaatacgtgggtgatgaaataatatgcacaacaaacccccatgacacgtatttacttttgtaacaaacattcacatgtacccccaaacctaaaataaaaattaaagggaagaaactattggacttagcatcgtggcagtcagtcattgttgaccttgataagaacaggcatagtggagaggtggggctagaagcccagttggattggttttaaaagagactatgatgtaaggaagcaactgttgacagttcttgcaagaaagctgtgcaaagaaatgggcagtgatgggaagatgtgatcagaagtggtttaagtcttactttgtttaatcatagggaagtatggcattcttccctattacaatgtgttgatggcaggcactgagtcttgctagtcaatatccctgcgttctggaatgggcatggcacatagtaggtccagtgacaaatatcgagttaaactagccaagctttcctttttttaaaacaatgctccatcttatgtatagtgattttgccttttcagaatactttcatgtttataattttattttaattacaacactctgcagtaaataggacaggccttgttccctgtttgacagaagagtaaactgaaacatggaaaggttaaaaaccttgttcaagatccacagatatgccaattctttactcttctcactagaccacaccacccctaatcattagagacttatgatttgtttgagataccaaaatacttagtttttctgataggtcccattataaatattcagcgttcctaaataagctaagtgagaccatcgatcttaacatatagtaattgtcatgcataaaattttattgtatcaggcttgactgatgggactatcaaataatatattaggcagcattctttgtaataacaaaatattgaaaataatctgaatatccagattttctaaataagcaattgggggtgtagataaaatgtcatatttgtatgatggaatattatacaggcagttataagaaataaacttatctgtatagaacaacatagctctttttaaaatgttgagtgaaaaatgaaagatataagacatgcactattttttttaatatatacacttataccagaaacagttatttttttcattcatttttaggagtgggtacgtttgtattcaagtctaaaaagatgctgactaaatccatcaatagaagggaataagataagtgtagtggttaaaagagacattgttttatgaaaaggctagaatgaccaaaaaaaaaaaaaagttaatttaaacctgagtggtggggaatatatatttttatatacttctttttatttttttaaatttcatctcaaaaaaaaaactaatcctgactttaagatcctctacgggagaaaaatgcaacacagaacaaatagtaggaattactgaaatgcaacacagagcaaatagcaagtactattatacttcattgaaagtattcaaaaagattatttttgtttattaggaactgtttaattttaaagttttcaactgaaattataattcactaatatcattatattttaaggagagaatcagttaaggagatgtccatccaagtaattatttttcctacatcaaccataaaattaaagaaagaaaagtctccttttctctaagcctacttgtttgtttgcagctgacccacctccatacattgatggaattcgaattaacagccctcattatttgactaagataaagctgaccacacctggcacccatacctttacattagtggtttctcaatatgaaaaacagaacacaatccattacacggttcgggtaagtaaaaccaacacacaatgacaaaacacagtaatataaagtatgtaatatgctctgctttgtaagtggtattatctggagaaaaagtttatttctgaaaatgtattgctctctttttttgtgcttatcattttaatagtaaattatactttctgtagaaaataatacatttgaaaagaaatgtctttattttgaaagagcatttttattttcatagtaatagtttagccccgtggtaatatagtatgttggactaataatacatttctttttttctttttgagacagagtcttgctctgtcacccaggctggagtgagtgcattagtgcaatctcggctcactgcagcctccacttcccgggctcaagtaattctgcctcagcctcctgggtagctgggactacaggtgctgccaccatgcccagctaatttttgtattttttgtagagatggggtatcaccatgttggccaggctggtctcaaactcctaacctcaagtgattcacccacctcagcctcccaaagtgctgggattactggtgtcagccactgcacccagccaatatatttcattttaaagcaagcaataaaaacttatttcgctgtttaatatttttattgactttaaaaagactttgaacttagtgaaagagaatcagtcacctagaaatgtactgctctcatctagctgggaaggtcattgtaattttcttctatatagatttgtttgctctagataagcggctcaatttgaatagatttttagtgatgaaagggacattgggagctgctgccacccattcctttttcagatgcagaagccacagcctggaaaaattgtgatttgtcctgaggcatacagttactagcagagaaagccaagaccagacccctagcttctcagttcccagctcattaaacctgacctgatactaggctgcctataatgacttgtgtatgccaactgatttttttagtcttccaatatattcatgtatcactttgatgttcttgtaagtgtaaaatttatcaatacagtctttttttaaatctaggtatattcagcatgcagctttactttttcaaagattccttcaccatacaccttatcaaaacgggtgagaaaattcatttggttgtaatctcagcattcttttagaatttttaaattccctttcccatttctctcattttattgtttatatttagcaaaggcttcacaggaatataagggaaacgtaaatggcctcaatttgggttggaatacaagatcttcagtgagcaacatctgtgaaaagaaaattcagagaaagaagatgaatgcaaactttggttgttagagaaggcaatgtggatgaaccttaaaagtagcatttgagactaactgcagggtgggctacatgtatagaggaagattctatggaaaattcctggtagaaagaacaacttgattagaggctaagagatggaaataggggttagtggagcaaagcagcctggctgtcagcagcaaataaagatgggagagaggggttggagacacagagtggaaaattgccttttttttttttttgagatggaaaggagttttgtctttaagtggaattggaaatgaaattttgttaatactaaaacttttgtttttattagattaatggaaagtggagtggtcagagtgctggaggatgtggaaatttccaagagactcacaaaaataaccccatctaccaattccatatagaaaagactgggccgttactgattgagctacgaggaccaaggtttgtgatgagtaactttcttaaattaatgatgttctattacaaatgaacatagtataacaaaaaagtttagaaacagacctaagcatatatggacattggatttataacaatggcattatagtggagtgaggaaaggacaatcttttcaataaatggtatggaataattgagtatccatgtgtaaaaagggtaattagaaccctgtttcacatcaaattccaggtggattacaaacctaaatgtgaaaggcaaaacaatacagcttctagatgataatgcaggaaatgttttaacctcaagagaggaaagatttcttaagacaaagagcatattaaaatgtttgtaaatatgctgcattgataagaaaaaaatctgcagtttttaaaaaataaaaacacattcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtgaggggaggggagagggatagcactgggagatatacctaatgctagatgacgagttagtgggtgcagcgcaccagcatggcacatgtatacatatgtaactaacctgcacaatgtgcacatgtaccctaaaacttaaagtataataaaaaaataaataaataaataaaaataaaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctgagaggatttgttgatctgggtgatggttacccaggtgtttattcactttgcaaatgattaagttgtatatatgttttacttaagtgttatatttcatagttttaaaaggtttaaaaaatatagagaatacagcctgggcatggtggctaacacctgtaatcccagcactttggaaggccaagacaggaggatcgagttcaggagttcaagacccgcctgagcaacatggcaaaacctcatctctgcaaaaatttttttaaaaatttagccaggcatggtggcatgtgctttgtatagtcccagccacttgggaggctgaggtgggaggatgacttgagcccgggaggcagaggttgcagtgatcccagatgatgccactgcactccagcctggttgacagagcgagaccctgtctcatacaacaaccaaaaaaaaaaaaaaaaaacaaaaacagaatacaaataaaaacagaactaccttctaaataagattgggcttaattttgcttttcttacaaactaatccagcagcagcagttaataacccattagatacgaagatttgattaaactatttttccacaagaaagtcatttttaaaacctctaccagtttgataggtgaaataggtaaataaacctatttgctcttttgtacttaatttctagatagattgaacatgtaataatgttcattacaatattgtttattccctattcatgtttcttgcccatagagttgtcattttttttaattataagcatgaaaaaggtaagggtattaactccttcacatatttgtggatatttttctcagattgtcatttttctcccacatagaaaaacatttcattttaaaataatgaatctgtcttctggtttcattttgctgtggacaggaactctcaccacattaccaaattaattttcaccatattctgattattttatggttcaattttttgcatttaaaaaattcatatgaatatatttttatatttggtatgaaatacaatttaagagtttttttctaaattttttgttacctcatcaccatctaaatgaatctttccttactgatttggaatgccacgtttataatatgctaagtacttctgtaaattcagagtttgtttcagggctttctttcctgtcccataggcctttccatttgttacaataacaattttttttttcttttttttttgagacagagtcttgctctgtcaccaggctggagtgcagtgtgtgatctcggctcactgcaacctccgcctcctgggttcaagcgattctcctgcctcagcctcccaagtagctgaggctacaggtgcacaccaccatgcgcagctaatttttgtatttttggtagagacgggatttcaacatgttggccaggatgctcttgatctcttgaccttgtgatccacccacctctgcctcccaaagtgctgggattacaggcgtgagccaccgcgcctggccaatgacaatatttttaattataccctgtggccaggcgtggtggctcaaggctgtaatcccagcactttgggaggccaatgtaggaggatagcttgagcccagaagttccagaccagcctgggcagcatagtgagaccccctgtccataaaaaaaaatttaagaaattagacagatatggtggtacatacccatagtcccaggtcctgaggaggctaaggtgggagaatcccgagtccaggagggcaaggctgcagtgagccatgattgctccactgtactccagcctgggtgacagtgagaccctgtctcaaaaataaaaaagaggtcgggcgcagtggctcacacctgtaatcccagcactttggaaggccgaggctggcagatcacctgaggtcaagagttcgagaccagcctctccaacatgatgaaaccccgtcactactaaaaatacaaaaaaatttagccaggcacagtggcatacccctgtagtcccaactattcagaaggctgaggcaggataatcacttgaacccaggaggcggaggttgcagtgagccaagatcgtgcctctgcactctaacctgggcagcagagtgagactctgtctcaaaaaaaataaaatatttcccggggagcccatggtaaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtaatgttggcatttttattgtatctattttatactttactttttgtggcatcatcttctataaaccttattctcattttctctaaatataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactattatttgtacttcttacaattgaggaaataagcctaagagattaaaagattttgcccagggttcacaagccttcttccctgagccctgattgagctgctgtgtgtgtctaatggcacccacagtcacggccgtctagtcgagggagggacaagatctagacccattgtagagggaggaaaaacaatccaggccttttggaggttctaaataacagacagaccagttgaattgttagagaggatgactcaagtttctaattcagcacatggacagatgctcatagcttcagtgaaaggtaagttttgacacattaaattgcccagaaaatccagatctggaatcaacgtggtatagtaagtgagatcacccaaaaagtcaagagtcacgtgaactaaagatggttaagaactgatttgggggaagttttttagaaagtatttctaatttagaaaaaaatacatagactaacaggagatacaagaaaacgagggttgggggaggattaagaagcccagtgaacagaattcccagaagagtataattaaatgtcagatgtggtggagataaagaggccacagtgacagcagtaggggcagactacgtaaaactagaaatttgactaggtgatagtgtgagaagggagccctggtcaaaaggtggtctgcatccttttctggtgtaggagacaagcaagtggtaggctgatgggaaagggggattgaggcaggaaacaagagaaattcttaatgcccataaggaatactctagtgctactgactgactgcctaggctttgtcttttgtaaagacaagggaaagaaagccccagtgttagaaaactccttcccactttcattctctgcgagaagtacctagaaatttctagttattagactgtataacttgactctgctgtaaaaactttatcctagcttgggctattttccagatggtgtttcttctaggaggaaaaagaattgcctcaattgcagggaagtttttgctaatggtaagtcaagcaagtctcagtgtctttactacaggtaaaagggtgtaaggagattttatgagaactgaatgaaccctgaaggtcactagtcaaattcaggtatgctgttaagtgttcttgcttgagacccaaattacaagactggccaatttttgtatttttggtaaagactgggtttcactatgttgcccaggctggtctcgaactcctgggctcaagtgatccaccagccttggcctcccaaagtgctgggattacaggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccaggtaacttctgatctcataaagaacacactcaaaggctacccacatcaccatttgctgcaaaagaacagaaatcctttacaatgctctgtagccacattatttggtagaccaaagtaacaaggcccagacacatgttattcccatggtttcaaagcctctttggcctttagcggttttccctcagcctgcccacaatcccactccttattagaactttcctactccatttttccccccctttctctttaaaaacagccttgtagcattccataaaggtttcttataaatgataaatactgtaatgttggggacagaaaatgggctcagacctgaattgaatccctaactccactacttgctgtgtgaccttggtcaagttactttacctctgtaagcttcatgatcctctccatgcagggtttgagatgatgtatatattaaagtacctcatacatagtagttgttcaaatgatagtttccttttcctttaccttgaacctagtacttaaatatttgttgaaggaattaactcctgaggaaggagcttgggaaagagccgacagggattattgcacaggtaaggaaaagaaaggaagtatgcaaagacagcgttgggtgggttttcttgatgagcatgacagaaaccaagtcaaacttctatcagttttccagggggaggccctgggaaaagaggtctctatggtcagatgtcagtaagagccaccatttgctgagtgcttcttgggtgtcaggggttgattcatgtaagctgaaccaccaccctacacaacggatagtatacagtagatagcgtcatactccccattttacaggtgaagaaactgaaatacaaagttaggcccttgcccacatcatgccttagtaatgatgtaaaggtagctttgaatcaaatctgattacagctcttctttcctgcaggacttctcagccttgaatgttcaaatgtatactttgactctcaaagaggagtgaaggtgtaacattttcccaatttatttgaccacagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattggtgggtatgaaaatcctgaaatttggggggagagagaggtgtataagctctctcgtgtgaccaaaaggagcacaaggtgaagagtatgtgtgtgaatgggcatcggagggcacagggaagatgtcccagcaaaaggaacatgagcatccatgcaagggagtgtggctggagaggcagggtgggcatggaggtggcctggaagccactctgtggaatgcacagatgtacattttaacctttgggcagacaggagccacccaagactacgatctatccctgtactcttctcggagtctgaaaaggttggcaaagtacaatcacaagatttattttcttaaacaggttaatggatgagtatgtgatgtgtgtgcagtgtgaattcggggtcttttgagaaaagacccaccatattcacaccaaaggaagcagcatcaaaggctgctcctcggcctccttgggtgttggcatgtggatgatgcctgggcttgcccagagcaggcacaggtcctacaacaaccctcgccacctcctgcctcccctgcagaaaaatgccatatacacgtctactacttagctctcaggagatcagcccctgacacaccaaaaaccaaaccaaaacaaaaatacactagtcaattaagtgcaatagtaaatggttaaatggtgttcctctgcatgtatgtgtacatatgtatgttggaagagtgtgagcagaaactaaagaaaagtcaagcctgggtgaaggtactggggggtagtacagagcctaggaggaccaaactcttccttgcagatcctcttcctcactgaattgtcacctttccctcacttgcatgaggactgggcatctgccaagcttccaactgcccagcccctcctggctggggctgtgaccacacctggagaacaggcattcagtagccctgcacagcctgctctgggtctatctttggctgttaagtctaggtcatcataagtcctcctccttttgctaggaggcctagcaattgggaatgaagcagggggcttgtccccaagagagggtacacagttgtgcctgcccaccattatcaatgttgtataaaaatatacagggctgtagtgagaagagattggagaaaaaaaaaaaaactctactaaagccagtcttacagcattttatcagctcttgatcacaggaaacatgtattgtgaacacaactcatccctattacactgacagataaattgagggatagggccttgacaacactgtcaaccacagatcccagagtacagcgtgaatttaccaaatcccagccaatgggccatttaataatgtgcctttgaaattcctttttctgtgtttcctaacttagtcatatctagagcagcccaccccttagcatcctctgcttctgggggtcatagaatattagggggaaagagagcctgagcaggggggctctggtgaggccccagggtctacatcaaaggactactcagggtggtccttgagtgtgtgacatacaaaaggctgagaagatgcagactaggacagccgcacggccccagggaaggccctgtccagacttacttggacttgttgatggctctcttgagtttcttctccagctgtcgcatgcggcccatggcggcattgtacctggctgccgtctccttatgcaccagctcgctcctggtcttggtctgctccgcctccatgaccttaaaatgacagcagagttcagcccagtccagcccagaacagcccaggcttggaatattacttatattatttttcaaaaaatattctttgcccgggcatggtgacacatgtgtaatcccagcactttgggaggccaaggtgggtggatcacgaggtcaggagatcgggaccatcctagccaacatggtgaaacccgtcactgctaaaaatacaaaaatcagccgggcctggtggtgtgctcctgtagtcccagctactcaggaggctaaggcaggagaatcacttgaacccggaggcagaggttgcagtgagccaagatcgtgccactgcactccagcctgggcgacagagtgagactctgtctcaaaaataaaaatactctttgggccaggcacggtggctcacacctgtaatcacagtcctttgggaggctgaggtgggtggatcgcctaaggtcaggagtttgagaccagcctggccaacatggcaaaaccccgtctctactaaaaatataaacatttgccaggcatggtggcacatgcctgtagtcccagctacttgaaaggctgaggcaggagaatcacctgaacccaggagatgaaggttgcagtaagccgagatcacgccactgcactccatcctgggcagcacagcaagactccatctcaaaatatatatgtatatatagatatctatatctagatatatatttgagcaaattagtggtcagactaagaataaaccaacttcccaacagtggttttcttttcctatttatctattttgaaaaagccttgtgaggaaagattaaatagctaaattggctgtggcaatgactgagaaagaaaatggaaaaacaaaaaccagaaaattttgaactattttctgattcaacagctgtccactttcttctcaggttcctcgatctaagtagccacctagacctcctcccgttcacaccttggggcaggggcctgatgggcaggcaaatggccaaatagcagcagtgggaacctaagagatggggaacctaatggggagaccaccaaaaccaagaactaggcatcgtgccaggcacgatggcagtcaagccagcaaagcagccatgacttccattgtttggtcctttcccaaatattctgaactagttggctgtgcacagaagaactcaggatccagaaagggcaaactttacatttaagcaattaaattaaaacccagtcattcacatcagattttgaggtacacaaacatttgtgagcagaagacaagtcaaagttctggtgggaaattctggtgggaacactttgttaagtctgttgaaaaaaatgagttacaaaaccaatactcaagggccctcaatggccaaaaaacaaaagcagctcacaggcccagtcccagagacatgggcaatgttaattctctccttgcttacctacagaaaagcatcagaacaaggcctgccttgaagaaagaggagggaaacaaaccgcagttcaggccacataagcagcttgcgatttctttccctgtcttctgcctaccactcagtgttataaaataaaccggagagacagtagaggttaggctaaagggttattctctaattctgtattctctggggagcatccgagaggagcccagagggctcatggtcactagtcagctctctcagaccccgtagaacaattttagggaggtaccaccatgtctttagttcacagttaaaaaagaaggccacagaggaaggttgccaatgttctaccatctcctccagtcaacagccacaatcagccctaggatagtttacttattacttacgataaggatttttaaaggtaccatgaaaaattatgaaagacttttatatgggcattaaaaattacagggtgtcctgtctagggcacccttccaggctatctctgactttgtcttgaagctgttttacaaccctgtaagttgtagaaaactgacagtaatacaaatggtttttttttttttccagagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaattttatatttgtatcccaattatgcttttaccttcttaaaaatatcttttaacaaaggcttcagtgcttcagataatttttaaaaacagaaaaacaacaaaatcagagaagaaaaataggagagaactgagctaagctggcacgaggagacatgcttgctcacatgacttctcaaccaagaccaaagggctaagagaatcctttccctttgcttccaaaaccagatatttcacaaggaaacaaaatgcactaaaaatatctcatgcttgatacttggggaaacagcagtaaatcttaagctttaaggatttactggtataacctttatgaaaactcaaaccttcaggttcatcaaagacaacatgttgggggtgattgttttattacaaaaagatccaattaaaggtttacctttaaggagctgtcagaatgcattttcaacagacttgtagaacctgtaatttgagggtcctgtacagaaagagtcccctgtaagaagcaggattctcaccatctgcacacaggccctcattctatcttggcctctaggctgcaagcagaagcacaggctttctacaataaaacacttggaaagctccgagcccatggcaatactggcagtgaaaactgaagaagtggccagcacatcactgtcccctgcttcgccccaccaggccacgtctaccacatcctgtccctatctccccacttctcatatatatacaaaacctccagggcagccaggtgcgatggggctcatgcctgtaatcccagcactttgggaggccaaggcgggcagatcacttgaggtcaggagttcaagaccaacctggccaacatggtgaaaccacgtctctactaaaaatacaaaaattagctgggtgtggtggttggtgcctgtagtcccagctcctcaggaggctgaggcaggagaaaagcttgaacctgggaggtggaggttgcaatgagccaagatcgcgccgctgcactccagcctgagctacagggcgagactccgtcacacacacacacacacacacacacacacacacacacacacacacacaaccctccagctcctggaagagacctccacacaactcagcttcctgccttgaggaagaaggtcactaagcatgtcgccttggttatgtctcctaggtaatcaaggagctcctctatctacagcctagcatcaggcatgagctgtgtgcagtgatgtgggtcaggtgtggtgggataagtaaggaggagagcggctcaggggtaggtgtggcaaactgcaccccatactccggagcagcatactccggagatgctgaagatccagggaccacagagatactgctcagccccggaccctgctcatatcagcccacagaaaatagcaaacacccggcaccttcccgcatgggcaccactgggcactgattgggtgtttcaatctggcttggccagcctcttcgcggggtcccacaccagcagaatggcccaaccggcttagtagacatccaccaggcacagctcctcagcctcctgttacagctttctcgactctccaatctccagggcctttgcaccctcagttacactcccaacatctcttccaacatcacagaggggcggtcaggagcctctttgcccagggaggcaatctcactgtctgctgagaacctccattctgactgtttcagactgtttcctgattcttactgcgtccttgggcaatgagacctaagaaggcgcttcttcccactgtgtggaagggaggcggttcacacccaccaacgtcagggaggctgtcgtgagcagctcctcacctgccatcccaggctcatatccactgtgaaccaggagaagggctggccctgcgtcgtgtcctctccagcagccacctggggctagttcagaaacagttcgtgcctctcatttccaagtcacatttccctcttcctctgtctgagctctttcagcagacatcagaaaagccaatttctccctcccaggatgccagccctcctctctcagaggatgaaaagctatcaccttcccataaaggctacttcagtgccaaaacagctgaggctgaaggggtcctatgctgcccaagctccccagctggagagcagcagggaccccaggccctgtgccccaaggaaggctgctcaactacaaggttggcagctctgccacaagctacttgtattttccagagtcctcatcaaccccagcactaagcagaaaactgatcctttgtccctgtctgtgccactgcatgtggcctaacagagcacaccagggctgctgccacctcctagtatatcggcttcagccatggctccaagtgtggctgcctgatgtcaccacaggaagtgtgaggggccgcatagataatcttgggcacgttacgtgggaaccccagtgtcccgctgtgcctggagggatcgtgtagtccaagccactgccatttcttcaagacagccctgggcctttctgagcacggaattttcttttattagacccttaagtaatactttggaagaagagggtgagatgaagctcccttgttctacagaaacaagcatcctagagtacccagaaggcagacaagggaggagacattctctagccctttgatcacacagctttcagctggctgagcatgccaggcccgtgaggctctaggaggggtcaacatgagcaccactgggggaaacgctaagtccagagagttcccagttactcgacactgtttcaaagccaaccatgcaagtgtgtgtcctggagaaagaattatgttctgcatcatccattacattcggagagcctgctctgcacgctgaaattctgagtggcacagggacgtgatgggggaaagctttgccacaggcttttgtctcttgctggtgtctgtttttaactcatctgttcaatgaggggcatttccagcctatgcaactgtgaagggatctgggaagaggaatatcagctcaaaggtggaaatcctggcatgtgacccggaacacctgccaatctgcagaggttgcccccaagcccaagaaaaccaaatgggcccttcccttcagtggccacagagaaggcacatatcagctggccctcccagggccctatgaagccctcatgacctcaggagtacagggccatcttgtatagccccacaggtcttgcactgcacaactccaaaaagcgctattcccaaagtctgtggtatgaacggtgccctgagttatacagtgtggaggtctggggatgccactccttgggaggccacccactatccactggggccctgggacttaaaaatgagagatacacaaagcagaagcatggtttgtttatctttaaacaacagattaaatgacttctgaaatgcttgcttataggctgacatgggtctccagctggggtggaagaagggcaaaaaggaaaagtggcccttcagctaatttcttggaagaagctaccttacattttgtccttttcatatctatcgggctttggcttgtgaacttccaagatttccagccaccccttccatttttctcgagatgacccagaaaagttgtttctagcccacgtctagctctgtgagcatcacgcccactagggggcaggaggcgcaaggccacacaaagccaagctcagccgagagtctcaggctgcagggagaggtgcgtaaagtcaacgcggatttgactcttgaagtcatttgtgtgccaagctttctatttaaggaagcacaaggccatctttaattatcagatcccccaggacttgagccactgtggcaggtgacatttaaaagggaaatcctattggcattaacctgctgacttttctaatccagtcccccagacggctttctcaaggagtcaccaagacctcttgcaaccccgtacccgcgccgtccagggtcttattggagctgctgaagccacaggtcagctcacccacccaccctgcagcaaaccagccctacactcgttttccaggcgctgggaatctagacagagaatgcagaggggcacaatggacccaggctggtgtggggggataccaggaacatgagcctgggcagcccaggagccaagcctggaagggggaagaggtatccaggaacattctgcgtgacttctaagaaacccgatagagttaggcaggggtaaccaagtactgctgagccaagaactgtccctagctgctatggtctgaacatttgtgtcctcccaaaattcttatgttgaaactgatccccagtgtgagggtatctggagatagggcctttgggaagtgatgaggtaatgagggtagaaccatcatgaatgagattagtgaccttataagctcatgtaccccttccaccgtgttaggacatggaaaagatggtcatctgtgaaccaagaaacaggccctcatgagacactgaatctaccaatgtcctacctaccaatgcacttctcatcctccagagctgtgaaaaataaatttctattgtttaccaactaccctgtttatggtattttgtttagtattttgtcttggcctgtacagactaaggcacaccatttctggctctgagtaacgcagtcagagaggtggtcatgagagccagtaaagaacccaatataatgacataaaacccagcaagccaagctgtgagtaaggatcacacacagtccgcttcctctgtgcctgtcaactccctgaatcccagcccagaaggcctgtcgtaagtacacacctgattctggtctaatccgccatgacccctgccttcctccgacagcacatacccgaagtgcagcccccatttagggctgttcatcaaggtctccccatcacagattcgaaacccagccagtattgctggggttccatgggagcaaaccctggaaaacctcgtccctctggaagcctgagtccagtcaagaccccctggggatgacccaaaccagacaaacctcaagcaacataagggaaggagcagctctcgctgtcacggagagacactgtgactcattctggagcactggcttcgtaccaagcgcagccaagagatcatacggagatgacaacctgtgattttcagggtgttttcaggcaacatgcctgggagtcgagtctgttacctccgctcaggggaagccagcgcgcatgcacgcgcacacccccacagcacacccggccatgactcataccctctgagtggcgtgattcagcatctcctgccaggcggagtcgaactgccgcttgtcatcctccagcagccgctgctcggccagggagatggtctccttggcggcacggagcacctctgtggccctctggaagtcctgcgtggctttctgagcttccagctgagcctgtgtgagaaagaatcctcatgaggcctcagaaaatggcaggggctccccatggtccattttacctttcaaaaaataagcatcccaaggaccaggacaagctcatctctgcctcttcactcctggcacccacaggtcctcatagatgccagacagggcaatggacccctgatgggggagtgagcaacaaatcagtgagcgaacaatttccacagttctgggcccaatggatgagataaacacatcagcccttggccagaacctgacatggcaaaccagcccatcgtgggacaggtacagccaaccccacagcctttctcagaagctctgcctcactcgaggcctgtcaccttccctgcccagatctgtggctcaattcatggcaagtcagaaccaggaaggcccccagagatcatggtccaaagacttcactctatagaagggggaccttagctgagaggacacagcctttcctgagatcacacagctgactagatgcagagctgtgccagactccagccagtatgagttccagcccagcactgtcactctgccagacagtctcccactcaactcacacccactgacaccagcgacaggccaagtatggcaccaggcaggcaaagagaaggacctaattaattaacacaacacggtccctgctttcaaggagcatcaggtgggagaaccaataccaactgtagctgaccaccacgtctagagctgcccccactacatgtgtctactgattgttcaaaatgtgattaatcccagccaggtgcagtggctcacacctgtaatcccagcactatgggaggcaggcggatcacttgaggtcaggaattaaagaccagcctggtcaacatggtgaaaccccatctctactaaaaacacaaaaattagccaggcatggtggtgggcacctataatcccagctacttgggaggctgaggcagaagaatcacttgaactcaagaggcagaggctgcagtgagccgagattgcaccactgcactccagcctgggtgacagagtgagactccatctcaaaaaaaaaaaaaaaaagtgattaatcccaattgaatgtaagacatccctaatcttaaagacttagtacaaaaaaaaaagaatgttaaatatctcaataatttttattatatgatgaaataatattttggatatattaaattaaattaaatatattattaaaattaatttcagctgggtgcaatggatcccacctctattccagcactttggggggccaaggcaggaggaccacttgaggccaggtattcaagaccagcctgggaaacatagcaagaccctacttctggaaaaaattaaaaaattatccgagcatggtggcacatggctgtattccccactccttgggagcttgaggcaggagaccgcttgaggttacagtgaaatacaattatgccgctgcactccaacctgggtaacacaatgagcccctgcttcttaaataaataaaatttaaagattaaattcacagaggctgggcacggtggctcaaacctgtaatcccagcactttgggaggctgaggcaggtggatcacaaggtcaggagtttgagaccagtctggccaacatggcgaaaccctatctctactaaaaatacaaaaattagccgggtgtggtggcatacgcctgtagtcccagctactcggaaggttgaggcagaagaatcgtttgaacctgggaggtggaggttgcagtgagccgagatcacgccattgcactccagcctggatgacaagagcgaaattctgtctcaaaaaaaaaaaaaattaatttcaccatttcatctctccccatctttccttttttactgtgaccacagggaaacttacaattatacaggcgattccaattctatttcttgtggacagtagatacctttaccccaagatgggccatgtgatggcagctgtgtgactgcatgagaaatcagcactgaaacatcacagtcaccactctacaggctcaccttgaattccccagcagggtagaagccacaaacccgcctctgcagcgtcccaccaccctccctcgtcccaccaccctccctcggttaaccacatccccaagtcagttacataagccctggtgggacgtccctaaggcagcccctgggactcgggaagaggggaactacagggaccccacccttccccaagcaattcttgcatgacttcgaggaagtcttcagaaaccacaggctgaggacgctttgtgaagaaggttaaagaagggggaacaaaaaaatcagagactcagagcacgccagcccccaaggcaaagaacagcttttcccgagcactctgtgattgtgtactgcataccagacccagacccagccctccaggcgacgatgacaatcagatggagacccgaaccaagcatggagtggacactcagaagtctgtaatacaacgctgtatgtgacagtgccacagcaggaagggaggaatggcagggaatgtgaaggagaaattatttccagtacaaagaaccaaggaaggcctcttaaaggaggaggatcccgaactcaggactaaggacacaaatgatttgaaaacatgggctgatgaggtgggggacagaaggaaggatttgagactctaaagacattacaaaacagagtgcctgtaggataaagacattacaaaacagagtgcctgtaggataaagacattacaaaacagagtgcccgtaggataaagacatattacaaaacagagtgcctgtaggataaagacattacaaaacagagtgcctgtaggataaagacattacaaaacagagtgcctgtaggagattcgatgatacctcagatcaaatttttaaaaaggactccagtgaagaccttgaatgaatgccaggctaaaccttcaaccaaagtggcccagggacctgcccctgctgtggactcaccatgtggccctgggaccagtcgcccacttccactcaggtgtgcctcagctacacaaggagaacaaggatgcccaccctccctagagctgaccaactcacccccccaacccctgccccacctcgtgcctccaggcccattagtggttcttagttctttcatgtgaggacagccctgcagggcctccgcaggccaagctgctgggaacgagaggaagcagagggaacctgtcaccttaaaagccactccaccccctacccataggtggcctctcctacctatatgcttcacaccaactccaggagacaggatgaatcccacaggatcctaaaatgggatttgtatttgcctttttaggaattttttagtatttcaattcagcaacatttaagggtaaactctcttctcccagttctctctgcttcagttatgaatcccttatttcttcaagcaagaaaagatgctcttttgacggccttctgaaaggtggctgctgtaccacgggcccagcacctcttcacaccctctgccatgtatctgatgagttccaaataagagaaccagatctctacaaaggaaaagaggaagcccatgtgaagctgcctttgagaagaacatgtgctgtcaaattccggacaagcgtctgaagtttctgcgagattccttctcctgtacagtgacataggatacatgtttgccttgccatatcacaggtacaactaatgtgaggcctcattccacatttaacccacagaaaccagatgccatctctccataattcatgcacttaccggttcattcactcaagtaagcactgggcacctgtcatgccccactgtctattctctctattcgttgtggtctcaaagggaggcaatatctcagctaaagaccctcacttcccagccctcactacaactggtccctctggtaagtgacagctaatgagaggtaaatgaacactgagtgagatttccaggaaggctcctgttatggactgaatgtttgtgcccacccaaatttacatattgaagccctaatccctaatgtgattatattaggaagtggggcctttgggagccatattagtccattcttgtactgctataaagaaatacctatgggccgggcatggtggctcacgcctggaatcccagcactttggggaggccaaggcaggtggatcacttgaggccaggaattcaagactagcctgcccaacatggtgaaacaccgtctctactaaaaatacaaaaaaattagctgggtgtggtggcagaagtctatagtcccagctactcgggaggctgaggcaggagaatcacctgaacccaggaggcggaggttgcagtgagctaagatcacaccattgcactctagcctgggtgacagagcaagactctagctcaacaaaaaaaaaagaaagaaagaaagaaagaaatacctgagactgcgtaatttataaagaaaagaggcttaatcggctcacagttcagcaggctgtacaagaagcctgattctggtatctgctcagcttctggggaggcctcaggatacttacaatcatggcagaaggcaaagggggaacagggcatctcacaaagtgcctggacttggatcctgggtgcggggaaagtgctacacactttttttttgttggttggttggttgtctgagactgaatctcactctatcgcccaggctggagtatagtggtgcgatcttggctcaatgcaacctctgcctcccgggttcaagtaattctcctgcctcagcctcctgagtagctgggactacaggtccatgccaccaccactggacagtctccctgccagcaatacatggcaagagtagctgctaagacaccaataataatttttgtatttttagtagagacagggtttcgccatgttggccaagccggtctcaaactcctgacctcagatgatctacctgcctcggcctcccaaagtgctgggattacagggttgcaggtgtgagccgccacacccagtcgctacacacttttaaaccagatctcatgagaactcattgtccaaacaacagtgcttgggaggtggtgctataccattcatgagcaacagcctccatgattaaatcatctcccgccaagccccacctccaacatcgctgattacaattcgacaggagatttgggagggagcacagacccaaaccttatcaggaagtaattagggttagatgaggtcctgagggtgggaccctcatgaggagatcagtgcccttgtaagaaggggaagagagggagatctctccctctggtgcactgaggaagcaccatgctgtcaaaaggtctcctagggaagattctgcaaagcaggagtgtatcaggcagcaggccaggccaagacaggaagcaccaaagagtttacacacttatctaactgaggaaagtttaactgcgacattgcttctcagtgtcatcacaaaacacaggacttccaaagtcagaaaccaatcaatttcacaatcccggagagagctggctatctggttctcaccatcatatgaaagatgacacctagaaatctttggtacaaccgataacattttaccttcacatcgtaataaaggccccaggccctggtatttaatacattatttgaatagggctctatgctctcaggtcctgtggtgtgcacaagtcatgcagtgattcactcacagcagagaaacccaatgagccagcggaagaagtgaggccctgcttataatagtactaaagaggaaaatgttagcagagcttggtttgaggtataagatgcaatacagaaaaaatgttaaataccttcatgacttacagacactaacagctttcatgggaagagctccatggagaaaattttaaaaggcagcttatgggctgggcgcagtaacacacctgtaatcccagcactatggaaggccaaggcgggtggatcacttgaggccaggagttcaagaccagcttggccaacatggtgaaaccccgcctctacctaaatacaaaaattagctgggcatggttgtgggagcctgtactcccagctactcgggaggctgaggcaggagaatcacttgaatccaggaggtggaggttgcagcaagccaagatcgtgccactgcactccagcctgggcaacaaagtgagactctgtctcaaaaaaaaaaaaaaaaaaaaaagcctgctcataaatgaatgtgatgtgaccttcattagacactgtgactatgaagcccttagaaatgtggaaatgtagagcattccacgaagggtcatcggcaaaggaggtggcgggtagagaagcctggcattgttgaggctgcagtcatgcccctctgactcaacttccactgttgcccacaatggctcttggggaggaacaagagcatctgcacatttgcattggctacaacaaaggtccaagacaggagggagtttacagacctcccagttcaagcccctcatttttcaaaggagagcccagaataggtgatgtcacatagctgtttagtggccccccagagccaggaagccacagcccctgacccctagtctggagctatttcagttcaaccatgcagtgtgtaccccccggagtaactcattaacacagtcaccagacaattggacggtctccccgccagcaatacatggcaagaacagctgctagggcaccaaagacaagatggaaaccccactatgcacaggattgctacctcctgcctgcggctcccgtcctgaagccttacgcgggtccagctgacaggcccgtggttagctccagcaactgcaaaggaggtggctgcccaaagtcatactctagcaggtggtagctccaagtcaggaagagagctctcaagaccagaccaacctagtatctgactactcacaaacctacaggtctggatacagatgattacaaaggagaaaataatcatagcagttactgctttagcatttattctgtttcagataatgtgtataaagtgttctgaatatagtacatttatactatatagtatatagatatagtacatcatttaagtctcaaaataacccgacaggcctaacccagagctttcattctaaattttttttttttcttgagatggagttttgctcttgccacccaggctggagtgcaatggtgcgatctcggctcactgcaatctccacctcctgggttcaaatgattctcctgcctcagcctcccaagtagctgggattacaggtgcccgccaccatgcccagctaatttttgtatttttagtagatacgaaacagggttttttagtagatacaacggggtttcaccatgttggccaggctgaactcctgaccttaggtgatccgcctgcctcagcctcccaaagtgctgggattacaggggtgagccaccacacccagcctcattctaaacttctattaaacaccacttgccggtgctgcaaactcctgacaaagaagtaccagtcaaggcagcgcagccttagctctccacacaaatcaaggacacagtggccaccgtcacacaggtcgggatgggcagggaggtttggagggtataagatttgcagagaccgccaacgaggagcagaggagaagtggggagaaggcctgctgctgtaggagctgagctcatccccaaccagagtcccgaaaatggggtctagagaggctgatcctgaaagccctcatgcctgcctgagcttagcctcctaccccccaccacacagtctcacctgctctgaggaacaacttggaccccattcacaggggagccaggagcatgaatgagatgcagagaggcacggggcaggcaaaatttccccacctagaggcacaggcctcctactgccttccccactcccctttctaaatgtcttagtacttaaaatccaaaaggactctggggtttacttgggaatggttgggctcagtatgcatacacccccccagcacttggccaaagcaatgatggagcaaaagaagcttccagaaccccctggatgcctggacatggattgggaggaaggaatgccccactttcttctagagaaagttggaaagataccagcccagggcgaagcaggctctgcgtgaggtgagcagtgaccctgcaggcacggggtggcaggacccggaggaaagagaagccccagccaaatgacaggtcggccagcttctacccctcgtgcttcgctggaggaatctcacccccacagggcccggggcaaggcccctgctcgatgggggcaaccacttggtaggaagcctctgtcctttttaacttgatactgttttgtccttgcctctttacagtgaatgtcacaggcactgctggaaagaacccctcccccggctagaagctcatgaagaaaagcatcagaggcctttccaacccaaccgaggaagatcaaaaacctttgaaaacatggtcaataacccctggggggtctcagtgagggagggatgggcaggacaaacatcaaaatggacaagagacaaggatgtctgttctcaactttattaaagccgtggttttctgcctatattctgaggaatcccagggaccggcagttcatggactgcctgagtccttccaacctgcaagctgcccatcctgcactcccccttcaactcctgaatgatgcttcattgaagaggaccagagatagaaactggccattctgatagcaccgtttcacccctgaggatgtctggcatatattttaatccaaattatctcagaacaaagtttcctttgaaaacatcttctggagagaattccattaagcccatttagttccttgattatttttcacaccgaggtgcttctaatttttcatttttatttagtcaaaattattctcctgaggattgattcctttctatttcaaatagatttgattgaatgaacagtttcatccatatcaaattttactaaatgtagcttgtggcacggagtttttcattatttctatcaaaattttcctgaatcagtttcttaaagatctaaaaatttggtgaggcgtggtaactcatgcctgtaatcctagcactttgggaggctgaggcgggcagatcacctgaggtcaggagttcaagaccagcttggccaacatggcgaaaccccatctctaataaaaatacaaaaattagctgggcctggtggcaggcacctataatcccagctactcagggggctgaggcagtagaatcattggaacctgggaggtggaggttgcagtgagccgagatcgcaccactgcattccagcctaggcaacaagagcgaaactctgtctcgggaaaagaaacaaacaaaaaaaaagatctaaaaatttgtcaaacataggggacatcattttttctcggtcccaaaggttaccatgtacagtctgagccattatcagtttaatagtgttatttctcccaacaatgtatattacaaagtaaacaagaaatctatggtatgtatctacccttagagaaatgagaaaaccacgggcagtcttaagagagacagcacctgcagctgtaccatagacagactacagagccctttaatatgtcggagcagcaagagagctttgcagggttagaaatatcaaggtcaaacggttttgttccagcctgagcttaaaggggaacttttaaaaaataaaaatgtaaaagctactacttgcttcaaaatacagctaggagtaagaagggagagctgggggtgggggtaaagatgaaacaggattgccccaaggttggtaatagaagctggatgacaaacatccaaggttccattacactgttgtctattttgcatatatttgaaagttttgaccccagtttctggcaagacaatccctactgccaacagtcatccagactaaccaggggtgagtctgactcaagggtttcggttgggggcatcagggaaggttcatcaagcactgagcccacctctgcttatcttcagtactagacaccagcctgcagttcacctctggacaccgcatgttcagacacagcacccagagggcttcccattgcactcaggaagcaccggttcctctgccttaagctggcactatttgtcaccctacagaatctccctaattcatgtaaaagctggcaggaggatggtcttgggccttatgttttcacagggcactacttagcctgagtcagtgtgcctcggctagttagccgactgatgtctatgacctgtccccacacttccatcctttcacaattacaagcagcttacagggcctgccagctacacacagcaggcctccgggaacgacgcatcccaaatcaaatccttcctgttgctgcagcaaccccatagatgccaggctcttcctgcccaccctagccagaagggtgcgcccacattcctcctcatcctcctcccgctctcaccttcatgctctagcagtgtgccaccggctagagaatcgactggccaggtgcaaggcaggggcctgagctgggggtagacagcagtacccaaaaggaaaaaaaccccacaacagcaccccagggtaccaccaccaaacctagactcctcacccacagaaccaaataacagggtctttgcgctcagggagacggagacaatgtagaccaattgttttattttctaggagaaaacttcagagcctaacaaataaattggcctgctcaaagcatcaagcctgggtattctatcagccccaatccaagctgccttccctgccagccagccacacagccatccccgacatcacactctcgcactctctctgtccccaaaacacacacgcaacatgccccacctcttaattcttcaaatgtgtgcaaactcacagagctcctccactgcggtgggtttccctgagctcagcagggctgtatcttcctccctgcacgtccactcacaattctcttccatctctgcctttgtcccccacctacactgtcattcccaggacccacaaaacaccagcatctcttaagacacacacacaccaatcagggaagctatttcatcctccactgggatgcacgatgcagacccaggccacgaacctggtcattgcctgacattgtgagggagtggagagccctgctttatgccgcacggtggcagagaactggaatattgcacgccgggaaagtccatgtgttctgtaattatgcctcatgacattcctttgcagttaatgagtagctgccggtttccagtcacaagggtggagcataggagtggagaggtggatgtataaagaactgggatgccagaagaggaaagagcatctccctcccctaagctatagctatagctaatttttgtatttttagtagaaacagggtttcaccatgttggccaggctggtcaagagtgaaacacggtcccccaacaagaacacattttgatgccgtgcacaaaactggcattgatttgaccaggacaattggaccagtgacaactgggccactatgaggccatggtctgtgtcaagagaaccaggaagagcagagtatatccctggcaccaacaataaccattatcttgggtctacaaccttgaacaaggacctgaaggcatcagattcccttggcagagctctgatctcccgactcctacctctctccttcctctccagcagaagaaccaggtggccagttgctccctcccccagtcctgcctctctacaggtacacacttctctgcctgggggttgcgagcataacacccactcctccagtaactgctccccaagtgcatggttccacctgcaccatgtggacaaacaagccccctgtagctctccaatcttaacacaccataatggcaacaaaagaaacattttgggccaggtgcagtggctcacgcctgtaatcccagcaccttgggaggctgaggcaggtggattacatgagatcaggaggtcgagatcagcctggccaacatggtgaaaccctttttctactaaaaatgcaaaaaattagccgggcgcggtggtgcatgcctataatcccagctactcaggaggctgaggcaggagaattgcttgaacctgggaggcggaggttgcagtgatgagccgagattgcgccactgcactccagcatgaggtgacaagagcgaaacacggtcccctcccccaaaaaaagcacattttgatgccttgcacaaaactggcattgatttgaccaggacaattgagccactatgaggccgtattctgtgtcaagagaaccaggaagaacagagtatatccctagcaccaacaataaccattgtcttgggtctacaaccttgaacaagtcactaaacttttcagattggaatgccaaggcctctgctaactccaaggaagcctcagttacagtactgaaaatacataattatacataattacagcagggacccatgaggaaagttctgtaatgcagtatctggcttaaacaacatacgcaaattgtgagcagcagactagttaaccacaagctatgttgcttttgctatcttatttattgctgtgcaagtttgcaaattttccataataaaaaagtttacaaaattgcttctcaatacatttcttaatcagctgttgctttgctatttacctaccacacagttctttctttaaactcgaaattatgtcactggcttaagcaatagcataatttgaggggaaaagggagatccatactatttatcaagacaaaaaataaccacggtttctagtcaaatgttttaaaccaatcacaataaaactttttttaaacagctggggaaatttgaaaaaggcctggatactagatgatatttaaaaactaattttgttaggtgtaaaaatgtgaccttttaaaggttcttacctgttagagatacatatctaaatacttaggtgtgcagtgataaatctatgaacagctttaaaataatcaaggaaaaagctagagggggagggtggacgaaacctgattggcaagaggttaacaattgttgacgctggtgatgggcacatgtggtccactgattattctacttttgcagaaattccataataaaaagttgtaaagaaatattttttgaaggcgttggttcatcagttatcacttttgttctttaccttccacataatcacaaaactcaagaaaacgcttactaaaagaatagggaaaaccaaaaatatttgtcaatggttgtcctcattaaaggcaacatttcaaataaatgagcaaacaaaagtaaaacaagaccaggtgcggtggctcacgcctgtaatctcagcactttgggaggccaaggcgggtggatcacatgaggccagaagttcaagaccagcccggccaacatggcaaaaccccgtctctactaaaagtacaaaaattagctgagtgtggtggcaggcgcctgtagtccgagctactcaggtgactgaggcacgacaatccttgaacccaggaaagggaggctgcagtaagccgagattgcaccactgcactccagcctgagcaacagagcgagaccctgtctcaaaaaaaggaaaagaaatatctaagattgccaatgaggggaggtaaacagtcaaaatgttacccaaacaagagacaggtttacaaggctgagctgctcatggtcccttaaagcccatattacccacatgcaatcttttaagatgtacgggaaatgaaggggcccagcaatggccccaatagcctgttagtggccacaccactccagttgtccaaaagttctcatctctaacttcagtctcttctgcgatgatttaaagctctcagctctttctctgtccctagcagagacagaaaaacaacaaaacatgcccacttataattacaaagcactaaatcaggatagagcactttcaaggagagccaaaaccaaactgcaggcacctggataagccctgtccctccccacaactccacctctactgccctgatggagggaggataaaggagccaggacaggggtgtttatgaaacctctactatatgccaggtgtgaagccacagagtccagcccatagccctgcttagaagtattgtcagacccattttacacccaaagaaactggtgaaggcactggtccaaggtcacagggctagaaaggaaggagactgggactcatacccaggtctccgactctgaccacctggagagaagaagcaccaatgcagggccccatattatcccccctctccagtggtatattatctattaagtttgacgtttcagtgaaccagctgctcctctggccgtgcttaagtaagcttcactgaagcttacaagactgactctctagactgtagatcctgatgggaacccacagtttgataaactctctccatgccaccatctgcacacccattttgccaagccctctctctacagggcatccaaaggcctcacaatccctgttcaacccctccttactgcctagttctggaagcctctgcacatgtatccagcatgggttctttcctggattatttgtaaagctttctcaccacctgcccacttggctggaagcgccaatgtcaaactttcataagctaatcctgggtgctactagtctctatttggcgactgctttccaacacacttgaaataaatgggttcaaagtcgttaacattcctcgtgcctcagatgaaaatactcaaaataaatgatggaggggagttatctgtcaatggccccttccctgccagctgggatcaacaaaaggagcctctcaattggagagcttctccatattggccaggattggtcttttgccagccagtacctcacacaacagcttggcctcagtcccaggggatgccatttaacagaggcagaggacacacccactctagacaaagtgacttcagttaacaccaactcactctgcaactcagaagcccagagctttctactcttggcctatgagcctgggagagacccataaaaggtatgtgaagggagaggagagaaggacaactcaaacccagggacaccagcacacactggacgaccgaatgcctggtgagtgccccagacccaggacctttggagttaagatgctacagcaaaaaagtctggcaacccacagccctctcctttatgcatagtacataggatttctaggatctcgtcacagcagtattgccccttgtgtcctggaaagtcttatgagagccaaaactgtgttactgaatttaattcccatattctagcacagtggctggtacactgcaaatgtttaagaaatatttgtataattaaggtacctagctatggtagaaatgataatccacaaacaactcccttatgatcaatcgttattcatgcatttgcgatttttttctcctgtgactcctgcaattagataaatgtctatctggacaggtttatccttgaaaatggccacttagggtgatgtaaaagctcacctgaataatcaaactgtatacagaaagtcatgtcatatgaacgccattctctcaagatctaactcattccccgctccgctcaacctcaccccttccaagctgggcgatacataacccagatcccaatggggcttcaggaaattaagcctgggaaaagaatttaccctctctgacttcataggaccaagtttctgtacttcttttgtcagtttgccacgttataaaatagtatatgtgaaaaaatactttgaaaactgcccaacgccatgaacatatcaggaatacatctcacgaattatttcaccattcacttggtcttctcaacaagactgcaaactctttgaaggcaccgtgagtcctcaccactaacatggtagagaagctgcacttagaaacaggtgctccgccaagccctccagtagccaggaacattggctcttctcttcccacctcctccacgtttcagacttccctgggtcactcagcactgtttgttgcctggtacacttaaacacagccaaaggagcaactggttcactgaaacgtcaaacccctacctccaatctaactttgcttctggatcagcataacttggcttaattttaactatcacctgcaagaagatctgcaaaggaattcaaggtcagagggacacagatgaaaatgagggcctaatataaacatgaattagcaaaacatacctttctggtaagcacagcatatgaaaaatctgagggatctattatcatgtaagtgggaagacgctcggcatggctgcagccggcgggccctggccagagcaggctatcagaaacagcatcagagcacaagggcatacacagctagtggcccctctggctgccggaggccataccacttcaggccacctgtgggcctgtggaaggatgggaatggcctagtgacagggccagggtagcagctccgcccctgcctggggaggcagaatcggcacaaactggtgtggcaggggctctccatgtgagcccgggttcctggcagatctcatttccacctggtattgccaagcaaagcaggtctgaggaactcaggggccttctcccagctctaaatggctgggaacaaacttcagccaatggaactgagaatgaaaaaggataagatatccacacagagaaatccaaatgtctcagggttgaaatgactacaccttaagcctttgtaattctgtcaattccaaacactccttttttatttcttttgtttttgagacaaggtctcactctgtcgcccaggctacagtgcagtggcagtggcacaatcacggctcagtgcagcctcaacctcctgggctccagagatcccaccaccttagcctcctaggtagctgggactacaggagcacaccaacatgcccagttaattttttgtatagatggggttttgccacgttgcccaggctggtcttgaactcctaggctcaagcgatccacccgcctcagcttcccaaagtgctgagatcacaggcatgagccaccatgccgggctgcaagcattcctctttaaagcaagtactcatttttcatctttactttgcaccacgcaacatgaagatgcggaaaggataagatgcaatttctgctctcaaggagctcacggttccagggcaggcttcttgacccatggtttagaggttgggaacacagatcaagactcaggcttctagactcattagctgtgtgaccctgagtactttcttacttctctgtgcctcagttacctcacctgcaaaacacagataataacagaacgtagctcatagagttgctgcaaggaataagtgagttaatacatataaagtgcagagaaaaggcacgcagtaagcagtacagagtgtcagctgtcatataagcaagcattatgtagcattagcttgtgggtattaacccacatgacatgcatgatatttaaagggacgcaacatataccatgaagttataatttatgcacccatgcacatgtctgttttcagaggatgacaaccataacgctcaagttctcaaagaagcagagctgacaaaaagccgagggagcggggctaaaggaagggttcatgaaagttacattgacttgtgccttcattttaatccagcaaagggtaaaagctaagcagtgctgtccaacagaactttctgcaataatggaaatgttctctatctgcaccgtcccaaaatagtagccagcctccacgtgtggctactgagcacttgaaatatggccagccagggtgaatcaatgaatttttggtttaattttaattaatttacatttaagcagctatgtgtggctaatggctactattttgaacatcacagagctagtcagtctgggaagaaagaagtcacaggcaaagactggattacgcaatgatgcaaaacattccctgatgtaatcagaaatcatgagtagaacaccacgacgtaccctgcaattgtgagtagtgacgtgcgtgtacactgaaccacagcacagagaagtccagatgccgaaagacaagaggggccaggccaggccgtgaaaagctttgtgcgctgtggtcagatttgggcttgacactggagacagaagaaatgttctgtactagccagggttctccaaagaaacagaactgataggatgtttatataagcatttattataaggaactggctcgtgcaattatggaggctggcaagttcaaaatctgcagagctcaaaatctccaagtaggctggagacccaggaaagaacttacattgcagttcaagaccaaaggccgtctgctgcagaattccctcttgctcatgggaggtccctcttttgctctattcagacctttaactgattggatgaggaccacccacactggggagggcaatcggctttactctaagtccactgatttaaacgttaatgtcatccaaaaacaccctcgcagtaacaaccagaattatatttgaccacatatctggacactgcagcccagtcaagctgacacataaaattaaccatcacatgtactaaagtttttgagcaagactatcagtagaactcactttggtaagataattcagccgggaggcagtagggagggatggaggtttcaggaggcaggaagaccggttgaaaggctatttcaggccgggggcggtggctaacgcctgtaatcccaacactttgggaggctgaagtgagtggatcgcttcagctccggagttcaagaccagcctgtggaacatggtgaaaacccgtctctactaaaaatacaaaattagccagacatggtggtatgcacctgtaaggtgaggtgggaggactgtttgagtctgggaggcagaggttgcagtgagccgggattgcaccactgcactccagcctgggtgacagaatgagagaccctgtctcaaaaacaaaacaaacaaacaaaaaaaggctatttcaatgctctgggtaagacatgagggattgcaccaaaaaagtgacaatgagaaatgactcatttagtatttgttaaagtatgaatgaatggattctgtgactttacaaaacactcactttatgagaagctagcatttcctcacaaatctccaacacaatgtagaatgggaaaggaggttttccatacaacataaagggagggaagtgatgtagcagagagatacaggtagttaccatagatacggagatacaggtagatacagagatacaggcagttactatatttccatgctcaaaagagtcttatgcctgctctgtgggtaacttaagcccacctttaactccttctaactcacagcctttctagaagataaactatagtaccaacgtggcagtctgttagctgctcccaatatccattccccgcttcatccttaaaacaaccttgcctggctagctaaaagactccaagtcaagcctcccttgcagctacctgtgactacctgaccaagttctagcaatgaatggaaaatgtgttgtctgggactcccaagtagactctttaaaatagaagggacatatatcccttcctcatttcctccttctgtcctgaaatgcagatgtgatggctggagttcctggagccatcttcaaccacaaggtgacgtggaagattggactcaaatattaggatgtgagcagcaaacagaacactcggtttcagtgaccatgaaatcacagcactaattccggactgcctaatttaggtcctctgttagttgagagacggaatccttgtgtgtttaggccatatttttgagttctgttgcttacgatcaaacataattcctaactgatagatgatacagctattattttgtgcacaaacaatgtagatttcaaaatttcaggccacataccttcacccatatattttcctatggccttgggtgttgatatggggctaggcagaagaggagcctacataaactaatacggcatcttacacctcatgatttccttccaacagctgctctcaataaagggcccactgtagataccttctaccaccttggatgagtgcccaggtcagtgtgaaaacagacacccccccttctctacataaggagaaccttcactaagctggccttaccctgagatcaagagacttaaagaatgcaaaaacctcagaagattttgatatgccactgcttttagaaataacaccaagcactttctctggggtgtggtgctttgacaaagggctggggcatacacttggggctgacagtgaattgatgagcacagggcatctttttttacttccatttaaaccacttcctcaggccgggcacggtggctcacacctgtaatcccagcactttgggaggtcaaggcagttgaggtcaggagtttgagaccagcctggccaacatgacaaaaccccgtctcttctaaaaatacaaaaattaggctgggcgcggtggctcacgtctgtaatcccagcactttgagaggccaaggcgggcagatcacgaggtcaggagatggagaccaccctggctaacagtgaaatcccatctctactaaaaatacaaaaaattagctgggcatggtggctcacgtctgtaatcccagctacttgggaggctgaggcaggagaattgcttaaacctgggagatggaggttgcagtgagccgagattgcgccactgcactacagcctgggcaacagagtgagactctgtcccaaaaaaaaaaaaaaaaaaaaaaaattagccgggtatggtggcacacactcataatcccagctacttgggaggctgaggcaggagaatcacttgaacctaggaggtggagcttgcagtgaactgagatcgtgccactgcgctccagcctgggtgacagagcaagactccgtctcaaaaataaaaataaaccacttacccaaaatgaaacctacaaagtgaggcttcctaaccagagcccatcattgccttaactgaagcaaacaggtgctccatcctccatgagaaggtaaactccccccatgcccatgaaagttttaaatggaagaaactaataaatatcaaactaataaaggccatcgagaatggagaaggggaaagaactggtgggaggcagaaacaggaagtggctggagaagacaggggaagacacagctgaggaacccacattccagaagattcttcagaagagacccagttgatgtggcctcccatgaagcccttcggaattctaccgggagctgaccagctctcagcaaaaccaagctagtgagggttggggtggacagaaaaaaatactagacccagctccttatcttagaaactcaatttcgtcccagaaacaccaggcttgggagtagctagaacagcagcatgagcattcgcatgctttttagtatcactcaactctcctgtctgtgttcacttgtgcccactcaaggctacaggctaaggaatgacaaagtgggagccagggttcctccacagctccacatgctgtggattcaggaaccccaagacagggcagctgaccccaaaactactttctctctctggctgatcaacactacaaattcccttttggtagggctgccagatttagcaaataaaaatataggccttccagttaaatctgaatttcaggtaaacaatttttttagcttatgtaccaaatatggcatagaacaaatttatacctaaaaaaaaaaatctgaaatttaactgggtgttctgtattcccatgttctatccgccaatcttacttctggcttaaactccacaaggacatcccactgggtagaaatgaaaagtctacctacagcctgcacttctaagcatttcccacttagtgtaaagggtgtagttctgtctctcacatgtgcagaggttcccacagcatgatgaaccctgagttgggaatatgcagtcccaccaggttggaagcagggtattccaagctatgggaatgtttgtaagtcagaaccacttgaagccccagagaccataaatctctaagtcttatcagtcatttacttctcagcatgaataatttcatcagattcttcagggtagattttcatagaagtcacaactggaagggctggggaagaagtagaaaagaaaggaaggaaagcaggggcatcctctgagtcaggaaaggaacagaaggtgcaccaagagtgcacagccggggcccaaacctcgtcaccaggcaacataaaaaggccagcctgtgtcgacaaaactcgtagcagaaacacaacctatgctctgatttcctttcactgaaaaattaatcactctgccactcttgccagggaatgcctgtggtttacagaggggaaggggctatccatgtccatgcaatcactttactgaaagcagagtacagttgagaagaaggaaggaaacatctgaagagcatcatggtttcagggaaccaaactccacaccctgtttcccctctaaccactatgctgtggtgacaaaccacacctgttagcttcacagagaacactgcctgcccagcagcaccaaggggggctcagccatgcctctgtgaatagcaaaggagataagaaaaagggagttgcccatgacaaacctcccaactaacaaggtgatggagggcagctcctccagcccagtgcttcctggctaagacctgcctgcaaccagtcccccacgcggacttcctgccacctgccagacagaatggggttgaatgcaaatggttcatggcatcaccagaaaagaaaacctaagccaggcgcggtggctcatgcctgtaatcccagcactttgggaggccaaggtgggtggatcacctgaggtcaagagtttgagaccagcctgaccaacatggagaaaccccatctctactaaaaatacaaaattagctgggcgtggtggcgcatgcctgtaatcgcagctactcgggaggctgaagcaggagaattgcttgaatccgggaggcggaggttgtggtgagccgagatcacaccattgcaccccagcctgggcaacaaaagcgaaattccatctaaaaagaaaaaagaaaagaaaacctcaagatcagcaacactctccctgctccagccccagacgcccgaggcagagccagccaagcaggaggtgcaacccttctggcagaagcccaaaaatctacttgtgtgtgtcaggagcctttgacctgggtcaaaagctgcaacacatctccttcctgaccccatcctaattcaagattccaagtttccaaagtgcagctgcttctttcccagaatcttcagccaagactgtcaggcaggatgtgatctttcaggcgaaggagagttaagagtccatgctcagttcttgccataaatctccaggaactctgctttgagacagatgccctgtcattccactacgtgcccttactttgggcagcaggaatgacgcagttcccaggaactggcctgtggccacccagggggaatgtgaccagggccacagggaagaacgtcactgagccagacctcctcacccaaagtcccgtggcaagaactgcccccaggcaggcaagtggctctgcagagataaagtgacggggaagaaggaaggcatgacaaagccacactgaagtcctagcaggaacagggcaccatgaggggaaagttcccaaggactccagattcttggaacaagagcttctcggaacaagagcttctcagttaccctagccaagaagaggcaggggtgtgcagggaaataactgcaccaatgagctcaaaaactgcctttagtcctaaaagcccattctcctcagatgtgccagagtgtctttcagatttgcaaatagtcataaatgcctcctatgtgccaggcaccagccagaaccaggtagacttggtttaaaccttcactcctgtcctcgcaaggtctgtgatgttaaagtccccaagcctcagtgattattccccctcagtatgatgaaaataatatcgtcttgcaggccggacgcagtggctcacacctgtaatcccagcactttgggaggccgaggcaggcggatcatctgaggtcaggagttagagaccagcctggccaacatgacgaaatcctgtctctactaaaaatacaaaaattagcctggtgtggtggtgtgcacctgtagtctcagctactcgggaggctgagacagaagaatcgcttcaacctgggaggcagaggttgcagtgagccgagattacgccactgcactccagcctgggcgatagagcaagtctccatctcaaaaaaaaaaaaaaaaaagaaaagaaacaagaaaaagaaaagagtaccactttgcaaaaagtactcgctgtaaggattaaatgagataatgtacataaaagacctatgaccacaaacccaggcccctagcacagcctcaacaaatcagggctgcagatagccccttaagagaacacagactctaagccccagtttcttcttctgcaaaagtaagtgtgtgtgtgtgtgtgtgtgtgtgtgtgtgtgtgtgtgtgcgcgcgcatgtttacgtaactccccctcatgcatgtaaaacacttagaaagtgcctggtatacaaagagtgttgaaattactcttcttcctcctcccttccatcctcctttcttcctcccttccatccagtaaactgtcaccgccataccactgactcccattttccctgcattctggatagataattaaccaagtctgttacagtctcccttcacattctcttagattaggccacaacaccggaaaggtttatgtaaaggcccagtctttgggctccaagactagtttcctcattcgtactataaggccaaaagggaaacaatgacagcccccgcacagagcagtgtgtgtggcacctaatacatcattagcgctcaaaaaatggcaaaaaatggagctgccattaatgtaaggacatcaatttctcaaacacaacctaagccccctaactcaagagcctaccatggctactttgcagcttctcaaccaagtctgaagggtaggctgaggcgtaaggcaccctcagctgtccatgctgttcctttcctgactggtcctttagctcccctaagcctctctttccaaggctctggcttccttacccaagttcatatctgcactgacccctcccctcagatctctgctcttctgtctttaccagccacccttcctcttgtgcttcggagtgtgcacagtgtgtccttcccctcaagcctttcccctcaagccttcctgatgggcagcatctcccgccaacacacacacacacagtgacacactccctagcttcttccctttgccatctacatcagagccacatggttcagcgcactaacaaataagcctctccatgtggctcttggcaaatacagtcagtcctcattattcacagcttccgtatttgtgaatttgcctacttactaagctttatttgtaaccccaaaatcaacacttgcagtgttcttggggccatccatcgacatgcacagagtggtgaaaaaatgagctacctgatacatacgtttctagctgatgtccaacaagaagccaccctgccttcttgttttggctctcatactgtacacaagtgtcctttcctcggtccttttagtgctgtgtttttgacatttttgtgctttttgttgatgatttttctctataaattggcctccaagtatagcaattaagtgctttctagtgctcctaagtacaagaaggctgtgatgcgccttatggagaaaatgcttgcgttagatgagcttcgttcaggcagaagttataccactgttggctgtgagttcagtgttaatgagtcaacaaaacgacacatgcagaaaaaggaagaggaaatttgccaatctgaacatgagttcactcaagtaagtgctaaagtaacatccgctgtgcatgacgaagctatggaaaagatgaaaacatggctggatttgtggattatctggcactaagcctgagaggtcatgacagattaaaaaagcagagtggacagcatcatcatgaggctaagagccaaagaagtttatagtcacatcacccagagtcaggagaacattcaaccctttgcagctagtgttttattatcaagaaatattgcatataattgattgtaagaaacacactaaataaggggtctttaaacagaaacacacatataacaaggttatgtattgatcagctgacaaaaatgttgtgaccagaggctctcaggaacctaacctctatttcccctaggagcaaagccttggtacttgctaattcagtgtctgtggcaactttatagaatatgactaccacagataatgagaactgattgtatttacctctgccataacaccaccttcaagaagatggggctcctggaggatacagaccaactgtatactccacagtggccactgcagacaaaggggagatgcttttctttgccaatcccctgacctgctataatcctcccacagtctcactccatacctcaaatggggaaatcatatacacacacacacacacacacacacacacccctatccaggtcagtaacaaagattctacttttgctcaaaacagcccatcccacacccttttataagactgccatgaggggaatgtcagctccacaaggacaggatctctgttctatgtttgataggtcaacaagtggctagaacaatacctggcatatggtaggtgctcagtcaatagctaccgaagaaaagaaaataataaatttttttaaatccccacacagacatgtaaagtaataacctacatttgacatatccttgagtttatatcctacctttgcagaacatcagcctctcatcctccacttacgaagtgtttttcctttttttttttttttttgagacagggtctcactctttcacccagactagagcgcagtggtgcgatcacagctccacgcagccttgacttctcaggctcacgcaatccttctacctcagcctcctaagtagctaggaccataagcaagcaccaccatgtctggcttcttaaaaaaaaaaaaaaaaaagaaatggtgtctcaccatgttgcccagggtggtattgaactcctgggctcaagcaatcctcccacctcaatctcccaaaatgccaggattagaggcatgagccaccactcctggccatggcaggctttctacaaacaaaatcaatgcctagaatttcccaacaaaggatcactataatactctgttcctctaggattaacataatagttcaggagattaattgatatgctcgacccatttcatttcattcaaaacacgattctccatccattcaaggcccatgccacactatccctttgggcacagagtgcttttgatcagtcaaaaggtaagtcagctactccctccctcatcattttcgatcctccagcacattctgccctcacaaataactcactatgtactcaacctacctgggctcactcttccacctggcacaatctctctatcttccatagccccctcccagccaggagaggcctgtttcctcttctacccacaggttctttgtggtggtgatcttttttttattacaaggcagcagattcaccagatactcaacatttgatagaaaaatacatctaggataatcttacatttattggatccaaatgctttacatgtactaattcaatcgctgtagtaaattgcaaaagtagctagaataagttgcaggtagactttatcgttcccaattcttgaatttggactggccccatgactgactttagcccgtaagatgttaataaacatgaaacaagcagaggcttgaaaagggctcaccctttttgttgctggaatctcaacactgtatgaaaatgaccaggctagcctggtgaatgaaagatacacgtggcctagtcacccctgctaccctagctgaccaccaaccaactgcttgacagataaggccaaggtcagccagcccccagctaatccatcaactgactgtatatgtgagagatcagctctaagcctgagatcagaaaaactggccaacaaaaccatgagctaaataaatgttttaagccattaagttttagggtggttggcttcatagcaaaagctaactgatatacaacttttctttttcttttttttttttttttttaaagagccaaggtctcaccctgtcctccaggatggaatgcagtagcacaatcataactcactgcactctggaactcctgggctcaagcaatcctcctgcctctgcctcctgagtagctgggaccacaggcatgcaccatcatgcctggctactttttgtagagactgggtctcactacattgcctaggctggcctcgaactcttggcttcaagcagtcctcccgccttggcctcccaaagtgctgggattacaggcctgagatccctcaattagccaactccattttatggatgaaaaaaaatgaggcacagagattaggtaacctgccaaaggtcccacagcttttaagaggtgagcctacaagtcactctacaagtttcaaatgttttcccactcatctcctttcctaaaggaggttatatgtaagacatggccttatatagccccacagacacaaaacaggcaactttcagcactaaataatccgcactattttgcatttgtgctgcccatcaagtttgcaaagtgctctgctctcttctgacgcattccaaccattcaaaaataacaagggttgcccaatgtccatggatgaatggataaataaaacgtggtatatacattcagtgaaaggaaattctgacacatgctataacatggatgaatgttgaggacattatgctaagtgaaataagccagtaacgaaatgacaaatattgtatgattcctcagtacttatatgaggtacctagggtagtcaaattcatagaaatagaaaacagaagtgatggttgcctgagcttgggagaggggaggattggggagttagtgttgaatgggtacagtttcagtctgggaagatgcaagggttctagagatggatggtggtaagagttgcacagcaagtgaatgtgcattcacaatgtgaatgccttaatgccatccttaaagaatggttaaaatgggggagaggcaaaaaagaaaaaaaagaatggtaaaaatggtacattttgtgttgtatgtaccttaccacaattttcttaaagaggagaaaaagaagggttgggactgatagtgataaaatgacaggtccaaagccactgttagaccagtcagcacccagggagccaggtaagcaagatacaccctgcttttcagcgtcattgattcacatgggctccgccctcatcagactgctcccctaccatatgctgaaggccagatggactggcagatatgtcaaagcagccttaaaaacaagcttgggctcaaggacaaaaactctcaaatcaaagccagtgccctgcccccaacctggcacagaaaacacacatcatgttctacctctgcttggcagaaattggacttggttttcaagatcacagaactggatctgactcattggctgaaaaatgagctcatatcaggaaaaataaaatcgatgcaaatttttaatgaaccaatacaatttccaccagctcaacaattagattttttttttttttttttttttttttttgagtcagggtcttgctctgtcacccaggctggaatacaagagagacatcatggctcactgcagccttgaacttctgtgctcaagcaatcctcctgcttcagcctcctaagggctaggaccacaggcacatatcactacatccagctaattttaaattttttttatttcatatagagacaagatctcaccatgttgcccaggctgaaattacaaatctttgtaaactcttcaaagaaaatcaagtgtgggaggtttttcccttttaagtaccctcaactgagacactggatattccagtggatagatagacatggatattccagacactggaatagacagacatggatattccagacataaaaaaccaccactatgctatcttctttttctccaaatggcatacgtacttttatttcaaaatattcacaaagttaagaaaaagtacagtacaaataactttttgctctcaaccatttgagtgagtacctgatgctccatcacccccccaaatactttttgtagttgttatttcctacaaataaggaccttctctcacataataataatgtaaccatcaaaagtggaaaatgcattgatacatgactatcatgtaattatcattatttcttttttttgaaaaaaatatgggatatacatcaaatagtaagagaaggtactaggattattttcttctgtctattttctaaattttctacaataaattctaattttttaatgaagccgaaacccaagctcatgctgggattccattgtcaaacacattatctcacttaaatcctaaggccaacctcatgagatagccagggctgttcccttgactgccagcatttcatgaatgaggatgcagggactctggggacgcagtgcctcctgactcaaactagaaggaactgctatctgaaggagtctctcaggcaccatttccctgctgtacataaccagagagctttgtaaatataaaaaggaagcgggggcggggggacaagaggaagaaaacaggaagtcctacttggcagcatctggaagtggacatcgcccccctcaccatcaggaaggtgagaggaacattcacacacaaacaagctcatccatctggcctgagcagcccaccctccacagagatgaaatgtgacatctgtgccctgcctcagcctttgaacatccttccagttccttcgctattgaccaacaaggtcccttggggttgaggggtaggagttagattaggaatctaaccttttctaccctgcttcttcctgcccacctgcaagaaggaaggagattacggggagggcttgcaggcataaagccaggcaggatgctctcaacattcatcttgggagctgcccattaagagtgactcactcatccccaggacctgggcatcatctgattcgaccgatgactcagtgccttgcccacaggactcagtaattgccctattgtcctcactagccaagagaagggatgaagagatggagaggagccaccatccactgcttcccaacagactaggagcctcccagccagctccctcctacctcttttcccaacaaagaagatttggggtgcagaagagcagggagtggtgtgaaatctgctccaggatgtgtcacagccagctggggacccaactgctaaacgggatttgaatgaactcaacccagacgaggctggatttgccagtcatgccactctccatctgcttacctagctaccaggtgggaaagaggctgtgagtaaaggagcaacggagaggaaatgctcatgacttcaagggagggcaggggaggaacctctggtctgttggtggctccccaacatcattcactagtttgttcatttattgatttatacaatatttgagcaccttctgtatgctggcattgcagatccagcaaggagccaaacgaatgaaactctctgcccttgctgagcttcacttactgtaaacaagtaaattataacaggtcatatggggagaagccccacagggaaaaaggaaagcaaggcatgggggctggggctggcagggatggtgggctgggagttaaccattttaaatgttagcctgagaaggcctcatggataaagggatagacatttgagcagaaacctgaagatgaggaaatcgggctatgaaaataccaggacatcgccaaacagagggacaccaccaaacagagggaaaggcaagtccaaagacctgaggcaggagcacgtttcacatcagcacagccaagggagtgacctgaatcagaggaccagccttgagaaaccccaacacaaagccccctagagccatctctgcccccaaacctgagctcagggaccagacaaggaaaacttcaggtagagaagccactgccgcgactccagtgggatgcttcaacagaccatccttcaatcactctgcagcatgggcacgtgggctgcttttaatagatacgcgtgggctaaatggcatcacagaaccataaatcccagtgttaaagactttcaggaaaggaggttttctgaattcctcgatatttatccaatgtttaaattaaatcctcagaagcttctcctcaaacctaacctgaaccctccatacttccgtttcaggtcaagaatgatacaaccttggcctacagtgggtaggacacatcctcaacttggggggcatctcaaagattaatccaacgtggacactttggagggggaatgcctcagggtgctggaatctgtgggaattggaaagtgctttttggagaagggtttcttctcccgggaattctagaggcctgggcagggcccagctggagatggaaaaagggagtggctgctgctcagggcttgtgcagaccaacgagcaatcagaactttgaagtatacagcccaatgcaccaggccagggaagaaagaagggtttcaggcagccactctgtctaggaataaaggcaacatatctggcaaggtccaaccaggaacttcagctcagggttcagagcataaaacccaaacacacaggtacgatcttggtagaactcccaaagcagcaaggggctcccttgaagagaaatgagaggtgcatggaaataggaaaaagaagaggaatggttaagtcctggccctcattctctatgggtctatcttaatatattcctagatttctgggacttaatttccaaagggtccatcctactgatatctcccccacagtgcacaacacactgtgcacatacacagtaggtgctcagaaactttgcattgttgttgctctctcattttttctttcttttttttttttctgagacacatttgtgctctgtcgcccaggctggagtgcagtggcacgatctcggctcactgcaacctccacctcccaggttcaagcgattctcatgcctctgcctccctagtgactgggattacaggcgcccaccaccatacccggctaatttttgtatgtttagaagagaggggtttcaacatgttggccaggctggtctcgaactcctgacctcaagtgatctgcccaccaagtgatcggcctcccagagtgctgggattacaggtgtgagccaccatgcccagcctcactaaacatcttcttacaagtggacacttttgaaggcagcatcttccatcatgtcataaacacaccacagggacagcactgggtcatttgctagtgaactacaatttggaccaactgcttagatcttcttgggaaatctgaactctcatctcaagaggcatcacagggttggtgattcacattagctctctaatcgggaagccgaagcaggctgaggaaggtgaataaagcccccagcccagagcctgccacacagcaggtactagtaactgttgagggctctttaccttccccattcacagggcctggctatcagaggctgcaggtgacacaagtggcacatcgcgtcacacagcagccaaaggaagaccaactcctaaaccagaacccatttccacgcagcccccagcaatcgcctgatcacagtcccctccgccactccccttctggtctccgtttcactgcttcttatttgggctctcaggacaaagaaccaaagtttcagcaggacgatggccacggaagtcagaatccgctaaggagtgtataacaactcacctgccaaatcttaaaaaggaaaaaaaaaaaaagaaaaagaagaagaaccgatgtttcaagagaagcagaaggctaaacactcccaagagtgaggcgaacgcgaggcagtaagcgaatcttcctactgctgtctgacaggttgtcattaggagcggaggaggaacaccctctggacacgtccccttaagtgcactcagcaccaactcagggagagcacccacttgcagggtcatccaaatgccagcactcacaccctattaatagtgtcgagcactggaatgaagcagattgcggggcggtgggtcactgcatttaagacatattggactcgagcttctaaccttcagcaggtgatacagtcaaaggcacccttaaaactgaggggtagtgaggctcgaggtaggggagacatctatggggctatcttacctgcctcgccaccctccgtgcctcccagtagggcttggagtcttccacagctttgccaattttcttcaccagttcatccagtttcaccgttgcttcaaccagaacagagcggaacttctgacgagcatcctgcagccaggggaaaccgaggaaacacagttgaggcttaagaagggatctgcaaacacctactggacctagacagaaacatcaacaaaggactttacccaacgtacagacccctaaagtagcacctttacaagacagtgtctagagcagcaccgcccaaaacagcttcctgccacggcggaaacgtcctgtgctctgcacagtgcagtgtggcggccaccagccacgtgtggctactgagcacttaaaactggccggtgtgactgaggaaaggagtttttagtttatttaattttaatcatctcgggtgtggtagctcacgcctgtaatcccagcactttgggaggccgaggcaggcccatcacttgaggtcaggagttggagaccagcctggccaacatggcaaaaccccatctctactaaaaatacaaaaattagccaggcgtggtagcaggtacctgctgtcccagccactcaggaggctggggcacaagaatctcttgaacccaggagacagagcttgtggtgagccaagatcatgccactgcactccagcctgggtgacagagcacgactctgtctcaaaaaaaaaaaaaaaaaaagcttagtaagcaacaacaacgcaaagtttctgagcacctactgtgtatgtgcacaacatgctgtgcactgtgggggagatatcggtaggatggaccctttggaaattaagcccgtctctactaaaaatacaaaaattagccgggcatagtgggggacacctgtaatcccagctactcaggaggctgaggcaggacaatcatttgaatcaggaggcagaggttgcagtgagccgagatcgtgccactgcactgcagcctgggtgacagagtgagacactgtctcaaaaaaaaaaaaaattaattcattatatttaaaattttttaattaacatggctagcaactactatattgcatagcacggtatagattaaaaagctttgtccaggacctctggacagcatgttgtcaaagctcaggactttaatcagagacatagattcaacactgaccaaacctctatctggggaagaatgtccagccatctctgacagcttcagtccaaatgatgctgtcaatgttaaacactgagtgcaaatttatttatttatttaccacatgccagacctggtgctgggccttgggcgtggccctgtctccagggcacttacagcctggtgggtgaggtaggtattacagcccgttccagaaaagtcagtgccagggtgggaatggtccagtcgccatggaactcagcagggaagaatggcgccagaccatgtattagagggagagtcacaggaaacttccagaggagtactatctaaacagaagtccaaagcatgaataggaaattgggggaggggaggaaaatactgagtcccaagcaggcagcagagcctgtgtccagataagaggggaatgggaacagcatggtgtctgcaagaaactgaaggaggccggaggtctggaatgtggagaatggcaagagataagggtggccatccatcctggcgacagcaactagcaacttggaccttgataggagttaggaaggcaaagaaggactgtgcaaggcttaatcatgttgtaaaagtcaagaaaccagatccaagaggtataaggagagaaaaaaaaaattaaataagttagtcccaggtctaggaggacctattggaagggatcaggtcagtgattcaaaccccacatcccctctacctctccctcaggcatctgcctgacaaagccacacctaggggaaggaaggacacatgcatgagtttaaaaaaaaaagagaaatggcagccgggcaccatggctcatgcctgtaatcccagcactttgggaggccgagacgggtggatcatgaggtcaggagatcgagaccatcctggctaacaaggtgaaaccccatctctactaaaaatacaaaaaaaaattagccaggtatggtggtgggcacctgtagtcccagctacttgggaggctgaggcaggagaatggcgtgaacccgggaggcggagcttgcagtgagctaagatcgcgccactgcactccagcctgggagacagagcgagactccgtctcaaacaaacaaacaaaaaactagctgggcatggtgccgtgtgcctatggccagggcggaaagatcgcttaagcccagaaggttgaggccgcagtgagccaagatcacaccactgcactccagcctggacgacagaccctgccctgtctcaaaacaaaaacaaaagaaaagaaaagaaaagaaaggggaagtggatactccaaaagaacaacacatgatcatgagctatgggcctggagactcaacacccacctgctggtaaaacatgtgtttcattggctagaggggcctgcctcacaagtaactatcagaaaaattttatgttattttgagacagagtctcactctgtcacccaggctggagtgcagtggcatgacctcagctcactgtaacctctgcctcccgggttcaagcaattctcgtccctcagcctcccaagtagcaggaactacaggtgtgcaccaccacgccaagctaatttttttttcgtattttcagtagagatggggtttcgcatgttgtccagcctggtctcaaactcctggcctcaagtaatctacccgcctaggcctcccaaagcgctgggattacaggtgtgagccacggcacccagccgacattttatttctaaacatgcaattgcaggggtttcatgggggcaaaggaggctctgatcagttctaattcattccatcatcccaagctgttggcttgctagtgggtttgaaaacgccgccggcattccaaaatatgaggataaaagctttacctcccatgggagcacctcagctcccgagcctggatcccatgtccaacacaggctttgccccctttcccctggttctgtgccatcatcatcatcctgatttcctctgccttctcccttatcagaccaggcttagggtcatccgctgcagcttctacaggcagaagacaagactagacttgttctccaggggaagggcccaaggaatagagaagccccacagagcttctacaggacttggcttccaataagagggaagcagcatgctgtcaaagcccaggattttaatcagaaacacagattcactgctgactaaagctctttctgcaaggccctaatcagggccgtctctatgaaccatttgtattacctataaaattgttactttccatcccatagggagggctcttagaaggaatcaaggagaatacaaatgtaaaacatttaacaatttctgggcacacagtcagtgctcaataaatgcatacaatttttttcctcctggtataaaaagagaccctgagaccctattaaaaaccacccagggagtttcccagaggcgagggcagctgacacggtggacataataacctgttccactgtgcaggcagccgctctgcaagatgcactcgcatgcatgaccgcatcctcacggtcacctccctggtggtggccagtgccagtgctgtccacattcacaccagtgagaaaacggagggccagatcggttagcgtgtggcctacagccggtcacatcaacccccaggcctactctgttaaatgagaattgagccccaaagcagtggcctacgggccaataagcttagtacatttggctgatatgctgtgtagtaaacgtcagggaaaattcacatttaaaaaaaaaatgaattctcaaacttttcatttaaagaaaaaaaatagctagaagcagagcagaaggtgcccccttaggcaggggttaccctcctctccagtccctatcactctggtgtctgaatcactcattcaggttccctgcccagccgctaaagatatctgatttgctgagagctctctggggcactggtgaatacaacccaccaacgctgcctttgtggagaaagaaggatggatacagggcacagactgactgactgctatgtggcaggcactactgtcagtgctttaaccccaccaatttgtgcaatcgctaacaatcctaacaggtaggtgctattgttgttattcacattttataaaggaggaaatagaggcaaggaaaagaaaggtaacttgcccatggtcacagagctgggaaatggcagagtgaacaattaaactcaagcagtgctaagactacttacacacgttgagcaacagacacacggctgagaaggccacccaacccaagtcagacatgaagaaagaggattccaccagacagagaagggggacattcgaccctccagcacggacggacgggctggcctggtaggggctggagcaaggacgcctcctggccattataaaggcatctgaactcaatcccatgaacaatgggagggcatggcacagtggggagaaggggagattacttcttgtttctttctttgcagaagattttctggtgctagttcatcactgaaattctgtctccctctgctattctctacttgccatttctcttcctttggccataaatcacatctcaaaatcaaaccttttaacctagttctatgtgatgggttttcttcccatagggttacttaagtctcaagtaatttatttccaatgcaccctttgtcagaaataattaaagaatgcattctaccacaaaaaggaaacataatcatagtttactagatggctcaactgtgaatagcacttacctagctgcaataaagtaatcaaatactgaccacaatggattctgctgagaagacagcagatgggaaaagtacaggacagagggtgaaaagagacaaaacctcatcttccatagcaggatgtccacagatagtcactcaaatgaaaaaaatcaagaagtagtcacacaatacatactacttggtcatagaaataaatacctccatcagctaaaatacattaaactaatatagttaactggctaggggagaaaaaaacaggggtagggtgggagaatgggatagtatagggctttttgtttgattttgtgtttttgtttttgggggttttttgggtttttgttttcacttgatcttagccaaaaggccgagaatcgatggggtttttgtcttcttaagagacagagtcttgctatgatgcccaggctggagtatggtggctattcacaggcatgatcatatcacactgtggcctcaaactcctgggctcaagggatcctcctgccctttccaagtagctgggactacaggtgtacaacaccatgcctgcttttttgttttcaactgtaaaatatcatagatttttctaagcaggggcatgacctgatcaaatttaggttttacaaaattgttacctgggtgcagagtatgttaaaagactcctcaggtgattctgatgggcaggttcagggcctgccagtctgacttgatgccctttttgtgactatctgtactaagtgtgtgaccatcaaagggtattaaacccagaagacttgatttgacatcagcgtttccttctataaatgaggctgtgctgccaggaatgatgcatgactggctgacttccaaccaccaacaagcctattcatcaaagatgcattgaaactgaacacaaagccagtcttccccgctccaccccccccccataagaaaaagcccacccagttgtttccattccactgaggatcacagctacttgggtaacagttcccagaagtattgaggtatgagaggccacaaaccaaaatctttcctgtctccccagtgttacagccgtaatattccttggtcctcacccccacctctcagtccctagtgatgtgacagggcctggccacagtcatactcctagccacagtgattgttcgatgagcaggggcgatagacatgacccatcataaccaatgagacttcatttcgggacctttctgcaactgttagaggaaatttcttccacttgagatgtttaagaggatggaatgaaagcctgcagcagatagcagccatcctggcatcatgaggggagagcctaacaataaagccatgtgtataaggagcagagtctgtggaatttagttcaacctagcttttataaagcatttctttcaatacatcttaaaaccaccttgccacaattgaacttagactttctgtcttgtttcttaaagaaaagacttgactgtgatcctttgtctcctgcaattacaagcaaatgtgttttccaagatcagagtgggggtggcttcaggaatgtccagggaggagagtaagctgactgctttccctgcagaaaatgagccatggaggggagtggctcaaaagtacaaacttatctgagagagcaagcagatcttccaccagtcaagaaaaagaatccgtttaccatcccagggctgtttaccaagggagtttttagatcagcacttgaaagagttcttaaacagttccctctgcttggaggaggcctcagctcttcaaatgtgaaaattgtgtttcatccattaggtgactcagactgaaggtaatttattcaagcaaagaattgctgggggtggtagagtctccctgtttgactgtgtcagtgtgtcagacaaacagccttgtgtcagataagagctcaagctaaaccacaccagccagcaccagtatacagtggaagcagcatgcaggttgaacatgaagcacacaggatgagtcagtgttttctggccaatcgctcacctgctcacctcaattaccttgcctggaaactgagaatcctggcttttcctcttcacaggtgtccccagaattaagtgagataaagatgggatggtgatgttttaaaaataactgtcctacatgttagagacgacaccaaacttcaaaagatccttactaatgccatttacaagtataccactttcagttggcagaaagaggtttcccaggcattatctgagacacacaacaaccctgtaaaacaggctcagccagaatttccatcccgagtttacagataagaaaactggaggccaggtgcggtggctcactcctgtaatcccagcactttgggaggctgcaggcacatcacctgaggtcaggagttcgagaccagcctggccaacatggcaaaaccccatctctactaaaaacacaaaaattagtcgggcatggtaggtgcctgtaatcccagctactcgggaggctgaggcaggagaattgcctgaacccaggaagtggaggttgcagtgagctgagatcacgccactgcactccagcctgggtgacagacattctgtctcaaaaaaagaaaaacaaagaaaactggagccttggagttccaggtgacctaatgtctttgcataaagtcacaggactatcaagtgtcaagcgttagatgtaagcagacatcttcagtattttttgttttttgttttttgagacaggatctctctctgttacccaagctggatgcagtgtcgcaatcatggctcactgcagcctccacctcctgggctcaagcaatgcccctacctcagcctcccaagtagccgggactagaggcacgtatgaccacacccggctaatttttaaattttttgtagagatgaggtctgtgttgtccaggctggtctcaaactcctgggctcaagcgattctcctgcctcggcctcccaaactgttgtgattacaggcgtgagccactgcaaccagccatcttcagtcttgtagtccagtgtgccagtcacttcaccagtggttctcagagcgtggtctggcgaaaccactggtgggggtgggggtggggcacctggaaaccttttcaaggagtctgcaagatggaagccattttcattaataaagacttgccattttcactgtcattctgagcgttcagtagagttttccagaagctacctgacaggtgacatggcaagaaatgacatgaaatgcagaagtaggtgagagaatccagctcttctattaagccagacattaaaaagacttgcgaaagcatgtacaacaattactctttcattgaattttctgtttggaaaaatagtccttttccataaaatgtattatttttgttaacatgtaataggctgattgtcatcttaatgaatatagaccttagaaataaatgtcttttgatttttatatggcaaatattaatattatccacaaaaacaaagctctctggggtactcaatgattaccaagaatgtgaagggggacctgcagccaaaaaatctccagtgtgctgcacgccacctgccctcaggcctgctctacataaacccctcttgaaccaaagacaagagtgtactttcaataagaatgaagcagttgttgcttctcagatcttttttaaatgcttctgattttgtcagggagaaagactccatttggtaccacaatgtcttcagcacctgtatacgtttgttaatctctttcttaaagaaaagggaagctaatccaggctcagagccttccgtaaagaggggaatctgctagaatttgataaggaaaacaatccaccagaaacaacataacattactctgaaagtcataagttgtaccctgacaaggtgggcacttcctatatatatattattctttaaaaaaaacacctgcttaaaaaatgtattttcctttgatggttttccatttataataaggctatttccttttcaaactgaagtaaggctgggcacagtggctcacgcctgtaatcccagcactttgggaggccaaggcgggtggatcacctgaggtcaggagtttaagaccaggctggccaacatggtgaaacccagtctctactaaaaaataaaaaaaataaaaaaataaaaaaatagccgggcatggtagcaggcacctgtaatcccagctacttgtgaggctgaagcaggagaatcgtttgaacctgggaggcagaggttgcataagccgagatcatgccattgcactccagcttgggcaacaagagcgaaatgtctcaaaaaaattctgaagtaaaaacatgaaccaatttaaaagacaacgtggaataaatagcacatgcagtcctaggatgtggcaaaaatgatggcggcagcagcagaataactggagttagggaaatccagccctagaatgataggaaagtctccattagcaggaacatactagaattctatgataaaaggcactatgaaaacatcctgacttactggccagtggtaaaggcaactgaaatgttccattcactatcacttttaatggcaaaaaccacaattacttttgcaccaacctaatacaaatcatgctttcttttcacccatccaatctattctctaagagcacttgtggcagctactagaacacacaaagaaaccactttaaatagcgcttgggtgaaaagggagcaagtgctctccagtgctggctgacggaacttctgtgacgatgacatgtgctacatctgtgccatccaacacagaagccacagccacttgtggccaagcaaacacttgaaatgtggctggtgcaactgagttttgtattttacttaacttcaaggggccaggcacggtggcttacacctgtaatcccagcactttgggaggccacggtgggaggatctcctgagttcaagagtttgagaccaggctgggcaacataatgaaaccccatctctactaaaaacacaaaaattaacctggtgtggcactgcatgcctatagtcccaactacatgggaggctgaggcagggggattgcttgagcctaggcggtcaaggctgcagtgagccaggatcgtcccactgcactccagcctgggtgacagagcgagactctgtctcaaaaaattaaaacttaattaacttagtgatttttttttaattgttttttgggatggagtctcactctgtcgccagggctggagtgcagtggcgcgatctcggctcactgcaacctctgcctcccaggttcaaaagacttaatgataatttaaatagctgcgtgtggctagtggctgccctattgcacagcacaggcctagccctagatccttttctgctttgagagatcctgccatgctttttgggggcctcaggatgccttccctcccgcctctgtctggtttttcttctcagtcccagctcctgctgggaggggctttcatagccctgagggccagagcaagctgattctaccttaagaattctgcagcagagatagaagcacaaagagtacaccagggcagagtgggggagcaagggagccaaaccagaaaggccaaggcaggagggtgtaggagccaggaagaagcagaggtagagagcaggggtatggatgaagaccaccagggagctggagccagccacaacactcctgctcatggcataggcccaattccacagcagtttgtgtcatccaactagaagacccaggtgaaacagccccaaggtgacaaatacaaatggaaaggaatggaataggaagaatatactaggatcttcaagttggggagaacttcaagatcactgctggaaaccagggacctaattccccttcccctgagtccttttcttttcccatctcagtccctgaccaacttcaggagtaggggcccctcagagtgtcagccagacctgctacttccttctgtgaggacttgccaccgtgtttccaatacaagactccctctcttaggaatcagaacagaggaaaccagaggagggagagacagacaaaaacagaggtgagagacagaaaaaagcaaatgtgcagagaaccatgaggtggcatgggaggggcagtgagagatggcccgggttcctgattctaatcctgtgacaacacagtcatatgatgtatcaatcaaacaggacacttttgagaataaggagaggcactattaataactgtgctgggaccacaagcatccaccaagactgcccagggccaactgaaacatgtggtttccctacgcatcagagccagtgacacttcccctcccttgagttccatgagactcctacaacctttcagaaaatcctccctttaatttaagctatttgagtgggttgtgggacaaaatgcagaatagtctaatcccagcttgggcatcgcgcagctccagaccctctgggcaagccctgtgcattcaacagcttttaggccacatcctatttcttcactccaaccctttccaaggcatcacactgcctgtccttatctgaaccaccaagaggttcctttcactaagaggacagagacaaggtaagaaaatataagggtcatcatggttttctccttcaagtttccctcctctgaggttaacaagggtcttggacccttttaaggcctaagtagaaccaattccctcctagacagaaagggtctggtttagaactctgatctaactatgaagggtttccaaacaagcaggtgagcacccagttccacctcctagaacattgcagccctcctttcaatccttggcctgtgtcaagattccataaccaaagggaagtgctgctatttggaggctgagttagggcaaaaggctctttaactttttagtttaaaataatttcaaacttggaaaaaatgagggaaagatgcagacaccatgcccctttaccctgaaatatttcaggtgcatatttcctaaagatgaggccatccacttatataaccagagtataataatcaaagtcagaaaattaacattggtacaacgctattaatctggtctacaactttctccaaattgcatcaattgtcccactaaattcttttataataaagggcaaaaatggttttcctggtccaagatccaatctaagagtcacacttggcattttgttatctaacactctttcacctggaactttgtctttgtctttcatagcctcaatttttaaacaatatgagccagttattttgtagaatgttatttggaaaagactcgctttttttttttttttttttttttgagacggagtctcgctttgtcacccaggctggagtacagtggcacgatcttggctcactgcaacctccgcctcccgggttcaagtgattctcctgcctcagcctcctgagtagctgggattacaggtgcccacgaccacactcagctaatttttgtatttttagcagagacggggtttcaccatgttggtcaggctggtctcgaactcctgacctcgtgatccgctggcctcggcctcccaaagtgctgggattacaggtgtgaaccacatacccagccaagacttgctttcagttcatcttttttgttgatgttacataggcaacagaatggaattgaaccaattacaaaaaaatgtttaaaatagcccaaggtagattcttttgtagttcgtaagtgtgatgactgggtattcatgtgtgagataggccatcctcgaatttttttatgatatgatgtgggcacattactcatctgctatgaaatggaaaaaaaaaaaagcccaagatacaaagcaccatgaacaaaagaaaaacctcatgagccctttaaacgtgacagcaagcacaggggtcagtcctacaaggcccgagaggatggactgaagttacataacaaccctgcatgcacataagcaagaacgtgctcatgcacacagctagaaagactgggggacccagtgctttttcatttatggccaaacacatgttcttaaatccacaggattctttgtgtaagaggatatagaaatgctgaaacagccgtgttttactgaattcaaccacaaaagcactatttccatgtttacgccaggaggcttcacatatgtcctcaactgcaagacctacgattttcttcaaaaattcacaatcattagatttcagacagattacaccactgatgtgcatgtttatttgggctgatgtttcaaccaccacccaagctgttatgaaatataaggtccactttataattagcacaagtcttagaatcagggcgatatggcgagttcatggcccagcctcagaaagctctagagatcagttagtgtagcctgcacaggaatcacacatccacccaccacagcattccaggcaggctggctggctgacttcttctggcttttggataacctccctcctgccttcagctaatcaaaatgttaagaaaggagagcacaggatgcaaaagagccaaagtcaaagtcaatggctgtaactttagagacacaggagatatgaccagaaggaacaactaaaaacatcatttcattggaatagaactaggggtgcgggggagtgaggtagaggactttcatttttcattataacttatcaggggctcttttaaaaaagctatattcaagtattgtttcaacaaaaataaaattttaagtctattacagcatagattgactacagagcttttgtatttctccagctgtcaagaacaaaggtggttcaaaatttattcaacatgtggctagatcagaatgcagatcccagtcaaacaatatcagggctggaaaaaagtgtgcccatcttttagtttagatgctcccatttcactgatgaagtgactgaaatctcgggagataaagatcctctcccaaggagctatacctgattaatatcagggcaaagattgaaaacctggtcccccaagtcctagacagcattctttcatctaagcagcctcagtgggggtctcagaatatgcatctgctatgcctccaaacacaaactatttaagggtatgggctccagcctcagatttctggattcattatacatcctggctctaccactccctggctgtgtgacctgagagaattgacttattcactcagtgtctccctttctcatcaacattctgaaggactgttgtgagaatgaataggataaactatagtagccacttagcacaaaacttagcatataataacctttcacaaaatagtggttatttttacttaggtgccattatttaataactggctaaggggctggaggaggaaaggatcaacatttgttggacatatatgccaggtaccatgccagacacttaacgaacatcaccatatttaacccttaacagccctggtaagacaggtattgcccttcacattttagaaggaaattaaacctagataagctgatataacttaccaagactgtacggcacattaagaggcagagagagaattcaaatccagctctgagctccaaagcccacactttccaccatcatatgctatgcagctatgtagtttagtttctgtcagctccaaaaaaaaaaaaaaaaaagctttcctatgtttttgtttttgttttttttaagacaagagtctcgctttgtcacccaggctggagtgcagtggcatgaccttggctcactacaacctccacctcccaggttcaaacgattcttgtgcctcagcctcccaagtagctgggattacaggcatgcactgcaatacctggttactactttttcttttttgtattttagtagagatagggtttcgccatgttagccaagctggtcccaaattcgtagcctcaagccatctgctggcctcggcctcccaaactactgggattatgggcgtgagccactgcgcccagcctcctatgcttttttgacccgaagtttcataacattgaagtgtggttttaacaagttccaagtggggaagcagatttaatttctatcaaataaatgcaataccgggactctctttccccagagaagacccagcaaaaccagtggcagggaaagaaaacagcacatctatctggaatagcccaaggggctttagaaccctaccaccctgaattacaaagcaacagtctaattattgtagtacctctggctctaggctccactaattttttctaataggtattgaagccatgccataatttttttctcagacaaaatttttaagaaatgggcaaagtggcgaagaattccctatggcaaggcccacagcattgctaaaaactgtccatcttgcctttatcgttgctggtttatttaaggtcactgggaatactaaccaaagtccttgctttgctggctggttaaccattaaagcacctcaagaagacactaaaatgtggttgtttatgaagtctccccacagaaaggaagggaggaaaggaagaaagtatatgtcctatgggcctcaaaataagccactgtctctacatcaccatgagggttgcagttttcaaatatggcctacaattctttggcactgccccaggatcaagaagaattagaatgcaggtgggctcatgactgcttggaccaacagattataatagaagagctgctctgaaggtttcaaggcttagtcagaaaaagccaggaagcttccacctggtcatcttaggacactcactctggaaggagccagaaaccaaaaggaagcaaaagtaccacactagaaaggtcacacgtaggcactctggttgcaactccagctgagctcccagcataagctttcagagccagcatcctctgtcagacacaagagtaggccatctctgacgtccaaccaagccctcaaggactacaaccaggctgacatctgactgcataaaactcctcaagcaaggaccgcccagctgagccctctcaaaaccctctccaaattcctgacccacaaatcataggcaaaatagaacagttgttttaagctattacggcttgggataatttgttagggagaaacagtaaccagaacaatgaagaagaaaaacaccccctttcttcttccaataaagccaaaaatcaagtaagagaacattaaatctgtgcacttcaaatctagcaaaatgaagctgaatccctttgcatgctggaaacaaaagggtgtggtgaatgaagacaaccaaatcccattcatcatgctttggttgggtttaatgccaaacaataaaagatttatattaagagggctgggctgcagttataataaacagcggatattcctctcattgtctccctgatagcagtttctttctgttagagcaaacattaacatctcttagataatccagcaaaacacagcaaaggaaaaaaaaatcaggcaagaatagaacaaaattttttccatcttcctttaaggaaatgaaagaggctgacttgctgagctctccaagagctgctttgcaaattctgtgatactcttggttaaaatgcactacaaaaaagcagtatagtctttaatgttggaaacatctatgtggcaatcggcagactaagtaactctcaaagagaagggctgggcaaagttacctgggctgcctgccaaaggatgaggttcaatagaggtttaattcatccagccaaaacacacacacacacacacacacacacacacacacaccccactacgttaaagtccctacaacaaatgctgacaaagaaaaataacagctcaaaattaaaaggctacagtccacagggaccacatctctgtcaacctggggatttgaagattctcattaaccacagggatagcaatgaatccatcaacccccatagcctgtcttcttttgagatgacacctcagagtcacagggtaggcaccttgaatacagctggggatacagtcacatgatttgtaggaaagtcggcgtgtactgcaatagcaagcacttatgatcctgccatgggtttcagctgaggggccagaagagtttgtatattatcttgttgatatttgtagcttaaaaggaagaaacgcctaggattttttaaggcaatacagtccatgtcaatattagacagctatttctatgttctagccaatggccagaacatgttttggccactaatagcattttgctaatgtggttaccatgaatgaagttgtgcaagaacctatacgtgcccacatttattgatttagaaatgatgctaacagtcaaatacacagagtaactaagttcaaatatctaaatattcttaatatttggaatgttttccattatatcttgatttattgtattttctaaataagcatatatatgacggtttcttggctgtagaagatcctaaagtgcctttatagcacttttcatccttccatgaattacaactagagtagcttaacaatacactaattcatcaagcaaacccacaacatcaggttttatctacaattaaggcaggaacaaccaatccaaggtttttcccatcagccttcatagttcctaaaattccttccagagaaattcatttatttggcttataaagacttttttttttttttacaacagacttcattccccacccccatcccatgaaaattataacagatggtcattgtaaatatttcagaaaacaccaagaaatgaaaactaaaaatcaccagcatcctcagcagctagcaacaactggtaacatctgagggtacatttttctagagccaggcttctcaaacaatgtggtgatggatcttctcccatccaatccaccgtaaatcaatatttctgtagaataaaaacaaactaggaaagtaaaatgccacctggatgtcacaacatcaaattgccaaaaaaaaaaaaaaaatctaaagtcttactctcaatttctgtatttacttcaccataactggtaacaagcagttcacattctttggcccacacaagaataactatgttagggccaggcacggtggctcatgcctataatcccagtactttgggaggccaaggcaggtggatcatttgaggtcgggagttcgagatcagcttgacctacatagtgaaaccccgtctctactaaaatacaaaaattagccaggcatggtggtgggctcctgtaatccagctacttgggaggctgaggcaggagaatcgcttgaacctgggaggtggaggttgcaatgagccaagatcatgccactgcagtccagcctgggcaacacagtgagactccatctcaaaaaaaaaaataataactatgttaggcctgtcttctcatatgcatatattcttttactatatatatggttctagatatgctctatatagttttatatatattttatgtatagttttttttcccccactaagtagaccatggccatttgtccatatccacacatcatctttttttaaagtgaaaggccactcttaaaatgctaacgcccccaagcaaggcagaatcttacatgttcatgagccaacatgtgcctaagtggacaggttctggggagggaaaggagaacacaaggttgtgttttaccagtgtcacaactgtcctcacggtcagtctgtccaagaacagcctgggaggccgggtgtggcggctcatgcctgtaatcccaacactttgggaagccgaggcaggaggactgcttgagcccaggagtttgagaccagcctgggcaacaaggagagaccccatctctacaaaaacaaaaattagccaggcgtggtggcgcactcctgtagtcccagctacttgggagactgaggtgggaggatcacttgagcccaggagttcgaggctccagggagctatgattgtgccactgcaccctaccctgggcaacagagaccaacactgtctcaggaaaaaacaaaaacaaagcgggaggccgggcgcagtagctcacgcctgtaatactagcactttgggaggctgcagtaggcgaatcatttgaggtcaggagttgaccagcctgaccaacatggcaaaacccggtctctaccaaaaacacaaaaattagccgggtgtggtggcacatgcctgtaatcccagctactcgggaggctaaggcacgaaaatcgcttgaacctgggaggcagtggttgcagtggcagagatcacatcattgcactccggtttttgagaccctgtctcaaataaataaataaataaataaataaataaataaataaagcagggctcactcagggaaactaattttcacattacagcaggcaggccacagcgcaacgccctgctgatccagtgactacaaagtccatcccgctgtaatcctggcctgtatgagccctccctctgacccccttcccagtgccaatctgacaaagaaaggtcatggcaggacctgggggaagagaacaacagagccactgccaggccccatggccagtttggccccagtggacatctcattggaaccttctctgtttgcagcgcccagcgggtctcagccctccctgccagccaagcacacagggggccctcttgtccactcaggctgggcagctctcaaagcactctctcacacagcatcccttaccatcctccaggctacccagggatgtaggcaagaattgcagcccccagattcaaagacaaagagactgaggcttccatgtgccaagtatccctagaagtcagcagacctctgatttcagcctgtatcacctgatgtcaagacagctgtcttccctccacctgcccttccccacggctttgggttttggttatttcacagcaaaaactgagacacaatcccattttaaagaagaagaaattgaggcacagaaattacataatctgccagaggtcccacagctatgaagagggagctgggattcaatgccaggcggtctggctccagaggccaagctttgccggctgtcctatagctaagtcactctacaagtttcaaatgtttctccactcacctacttccccaaagggaaataagcagtatggggggaccactgaagcccaaggccttcagtaccaccattctgatggccaaacttcaagtcagagctatgggggcagtgcagcagccctggctcaggctaccctgaagagacgcaaagaccacacatgtgttttttctttataatcaaccaatcaccaaaggtcctgttaacactccacctctccccaccccaaccttcctcaacctgcagacaatgtctgtaccgtcagctctcttcctcctccactttaaggctgatgttatctcttcagactatctggggtctgcaggcctcaactctgatgccccctatttcaacaaagctttggcctctcaaagggccctgagtgactctcctagaatccccctcaccccactacaattgcttgcttgaatccaggagacggcaagctccatgaggcagggacgtgcctgattatttgttgaccaccctggtccccagtgccccacacaggatttgctgcaggaaggcctccaggccaatgtttacttcaaccagatctcacctgtgtacaagaaggtcaggggtgtaggggctctgccagcttagaccgggcagcctgccaccaggcctggaatctggtgcagcttcaagaaacagttactcctccctcccccggtctatctatgcttcaaacattccctagcagtttcttcgaagcacaactgagtcttacaggacctagtccctagtgcattccacccacacgttttaatggagaaagtgctgggacgtatcactgtcctttgatagaggaatttttctcctgatttgtgctaataattcatgagggaggggccgggcagcttccagtttactctcacctccaagtttctaagctcaaaacagagtttttgtttgtaccattgctccttgggtccaaaaaaaaaaaaaaaaagttttaagagaaaacatttgctggttttcagagggaggaaaggcagagataatgagtgctggcttaagcatgtttgaggaacacagatactcagaaacaaagatttttcaaaccaccctgcaagtataagcagaaactattcccacctgacctgagcaatgaggaaaaggacggaccccttcacagccctggaacagcccactttcagagcaagcacgggaaatgatgaaaacattacaaattgtgcttaaaaccacataaacatgggcataaaatattacaaatctttattctgattagacttagaaattctcagtgtggcttctgttttaacaaacatttgaaaagagacagacctataaaataggcatttaaaaattacatcagcatattgagttttactatctcacctagcagggctgtcgcacacctgaatgacccatttatctctgactcactgcctcctcttccatccattactcgcccatgcctggcacaaggcccccttgctggccctcagctaagccaggcttagccctgatgcgccctccagctggaatgttcttcccccacatggcctgaggcttgctcactctctccagacaatactgcattcctctccctccccttgcctccaaacacccaccagctgagtccccttccagctctttgcctcctttgtatacatcagataacctaccatgtgtattttaactttttattgcgttttccaccccctctgcaatgtaagcctcagaaaagcagggacttctgtccattctcttcactgctctgtccccatcaccgaaaattgcccccatcacgtagtaggtgctcaataaatacttagtgaattaaaaagctggtcaggcgcagtggctcacacctgtaatcccagcattttgtgaggccaagggaggcagatcgctctcagctccagagtttgaaaccggcctggccaacattgcaaaacccatctttcctaaaaatacaaaaattagccagcgtggtggtgtgagcctttggtcctggctacttgggaggctgaagctggagaatcgcttgaacccgggaggctgaggctgcagtgagccgagattgtgacactgcactccagcctgagtgacagagcaagaccctgtctcaataaataaataaagctgactgatcaatggatctgtgggaaaatgcttattttcctaacttaaaacatcaggcttatatccaagggctctctggttaaaaggttcctccttttacagcttgaaaaggttggcttttgctgatataaatcagcatgcaaaggggacccagcactgttcaaataaggtcagaggcaaacccaggttgcaggaagagacagacatccaagtgacacggcagatggctggcatccagaggcccttttgcaatctggaatttaaatggccaagacaagaaatgggatgttaaatgtgggcctcaggagcaacacctcagtctccagctacccacagacaactgcaccacagcgtgagagcacgttagcagctaccagaagcctggtcaccaattcaggttcatcagacaaaaatcacgagaggtgccgaacgccccagatcgcaatcaaaaggcaatgggaaaggaaatgtggacagcagaataccttcccctgggggccctgaaagtagactatctcattatttgccaattccatacttgtgaattcgtctactcgctaaaatttatatgtaaccccaaaatcaatacacgcagccctttcaggttcattcaccgacatacacaggagcgacgttctgcctcctgctttcagtgcccatcctgtaaacaagtgtccttttcatggtctacttagtgccatgtctttcacacttttgtgctttctttggtgattttgctgttaaaatggcccataagggaagtgcagaagtgctgtctagtgagctttcctgagcacgagcaggctgtgatgtggcttacagagcaaatacatgttaggtgagtggccctgagttcaatgctaatgaatcaatagtatatagtaaataaagtgtcttttaatggaaactgaaaagattaatattgatcagttgatgaaaatgtgaccacaggcttgctccaagccctgcattttccctacaacaatggttccgtattcactaattcagtgttcacaactttatggaatacaagtaccacaaaaacaagactgggcacggtggctcacacctgtaatcccagcactttgggaggctgagacagcagtggcggtggggaggggggtagcgacgacacgagatccggagttcaagaccagccagttcgagaccagcctggccaacatggtgaaaccccatctctactaaaaatacaaaaattagccaggcatggtggcgcacgcctgtaatcccagctactcgggaggctgaggcaggagactggcttgaacccgggaggcagaggttgcagtgagccgagatcacgccattgcactccagcctgggcgacagcgtgagactccgtctcaggaaaaaaaaaacaaaacaaaacacttgactgtatattaaaatggctcattttcctgcccccatccttgggcatactccccttgaccaccccagtggctcactccacctgttcttctgcaaacagaggctcccctgcaggcatctgctcaggtgtcctccagcagcgcccctccagtgtctctgtcacacttcttactgtagctattaccaccagtaattattacccccgctctgctactcaccccaaccaaaaacgtaaactcctggagggcaaggtctttgtcttgttcacccacataaatgcagtggccaacagtgtctgacaagcagttggtgcccagcatgaagggtgaaatcccacctggctcctttgtgacagaaaacacctattaaacctatgcctcccagtgccaaatgtagctaacacttgaaacgtgtctagtctcaactgaaatgtgccctaagtgtaaaatatgccaaagatcttaaagacttagtacaaaaatatatgtaaaatatcagtaattttttaatagcaagtccacgttgaaattgtactgtcttggatattccgggttaaacaaaatatttaaattcatttcagctgtttctttttcgtttttaatgcgtctactagggagtttttaattgcttatgtagcctgtattatatttctatgagtcagtcttggttataataccgtgaaaaggccagccagcaacccagcccagccctggccacccccctcacaccctccagttcgcctctcacacggttccaaatgctctccagagccaggcaggaaacacctgtctggtggcttcctgtgacacacaaatacctaagtgtattcagaaatgggattcagaagtaagggctaaaaagagtttaacagattaaccaatttcaccccaagaaagtaagcacacttggggctgagatgtgggccatcttgttcattacccagaacagtggccggcacatagtaggcgagcaactagaatcaatcaatgcttttaaaaaaaaaaaaaaaagactatttccaggatgggtatggcaactcatgcctgtgatcccagcactttgggaggccaaggtgggaggatcactttgaggcctggagttcaagaccagcctggtcaacagagctagatcccatctttacaaaaaagcttaaagatatgaaaaattagccaggtatggtggcatgcacctgtagtctcagctactggggaggatgatgcaggagggttgcctgaacccaggagtttgaggttgcagtgagctgtgattgcaccactgcactgggataatagaatgcaggaactggaggagatctggaaaatgcctgggagtataagatgggagccctgcctctgaggcgtcatagtaccagaagatgctgagcctctgagtcctgatctggaaagtaaatagtccctaccctcctagctctccaggccagaacattctatgatgacagcagtttaatacagtggcaactggactgtttaatatagtggcaactgggctcttgaaacgtggctattgtgactgagaaatggaatttttagtcttacttaattttaattaaactcattagccaggcatggtggtgcacacctgtaatcccagctactcaggaagctgaggaatgagaatcacttgagcccaggaggtggaagttgcagtgagcagacatcacaccactgcaccccagcctgggcgacagagtaagactctgtctcaaaaaaaaaaaaattttaattaaattcaaatagccatacgttgcacatggctaccatatgggacagcatagctctaggctggtgtgacaggatggaatgagctaaaacgtgtaaaaaacactctggaaatgctaaagccctataggaatggtaagagttttgttgtttaatgcattagaaatctgagatcctgagaggtttcagttaccccacatcacagacagactcaattcataagtgaaagaaatgtaaacaaacacagattttactttacttggggagaaggacagcccatgctcttgtatacctacgatggaaatggaggtggttagcgataacccttcacgcaactcagagcaacaggctttttcatccacattgctgcatccagatttggtaactccagggcctacgcacgcagcagaaatcaaggctgccagtgaatcctggtagattatattcctatctcccacactctcactcttagggaccatgtgcttcttgtcccttccactgacgtttgctatttctcctgctacagaaacagactttgccaacagctccctgcattgggaaactgcgctgagagtccctttggggttctgacagtcaattcacagtctcctgaatacatatagtggttgttcaaatttgctgatgggtggtaaaagcaaccactactggaaaggggtgggaactaatcggaggctgtgatgaatgctaacttgtttacactcccattggaaaatgcacatgaaacccaaatcaagttttagtctcccaagatttttcccagcaggaaaggccttcccagtctaaacagctttttgttaccattataattatattctatgcactagcagacaataaagaaatgagcagggaagcagaaggaggcggggggtgagttattaggacaggaaagtcaagaaatggtcgaagtcagaggaaacaacacaacactctccaggacaaatggcaggaactgccctgaatatgtaagagattttgtgagctcattcattattctccattaaagagttcggctaattttcccctgtcctttcagtcacattaaaacttggggcttaagcgttgtgtaacgctctgcacagacttggtttaggccccatggagcttccataatgaaaaacaacatgtgcaattggatccacatgcgttccgcccacaggttgagctcagtggtgtattttattctgtcagggagctgttgctcaactcccaaggaggggggtccagcaataacactccagctatgaagacaaaattaaccagccttgtgccggtgtgagtgacatcacttcaccaagaacaggaactcagctctctgtacctcaagttcagtctcccgtctgttgatatcatccgtggactgatttaacttctccagttctccctggtgaagaaaagagggagaaaaaaagacttaagggatccgtcttttgtttccaatataactcagtccataacctgaaaaattaccccagcccaatttgcaggaaaagggaagaatcagaattaattcttacggcaaacagttgaggcttgactagaaaagcaaatgaatgtcggcatttctgaaaccattttcttgagggtgtcccttttgacaatgtcttcagagacatttggaatttgtcagaggtcaactattccaggtacatgccttcaggtaaaccccacctgttacaaatggtttaatggcctaatcaaaacagtaccatctgccttgagcaagaactttgcttagaaaacaataaaagacaataagcaaggccaagccaaaaatataaacccagtgaaatcatcaagggcagaattctggtattaactcaccagaattatttttctgtaaagggtgaaaatcttttcacactgccaattattcaacctacttagctggacgttttaaactagctttaatcccattcctttcaataaacatttacaaactgacattttgtaaaaaaagtatccaacatgaacttaactcatcattactatgcaaacaaaggatcttgctaacataatcccataccagtaacacacgatttattccaaaccaattactttaattaatagcattcctaatgcaaggattttttttccacctgatctttatcttgctaagctgacaaaacaattcatttaaaccccaaccactgagttaagtgagcttttaaattgatctgtgcactaaaaaaccaattaggtatccagaaattacagagcatgcttaaaagcaatttttttaaaaaaatgatttattgaaaaggtagaaaaaaaacgggccttagaaagggatttgctctgctttttgcttaggggtgaagaggtgaaactgtcactcctagatctcggcttggaaattgttttttaatcatctctcttggaaatggaggcacagccagccagcccaatcccctcgccgcctccacgcgtcagctttgcgcatcagttgtccccgatttcttttcatgcccaacctcacaacaaggaaaagcagggttttaagcaatttcaagccaggcagaacgttgagccagtgatgacaataagccgctcagttcgctaacaatcaatcagagaaggaaaacggctcaggccgggcaccttggcaagtgaggactctgcacccggggcaccggtgccagcccgcgctgcagggcaacgcccacccgcccacggtgcccggcgcccacgcgggcgacacctcctcgcagagcctggacgccgtgccatgcccgcggtgccgcggccgggcaggggtacccccgaggataccatggcgcccccgccccctttttccctttgttgcacatccacccgaaccaccaggcacgctgcaccgaccccgatcctgctacgggtcggcgggggactccccgcaatagagtcaggccgcatccacgcgggcactgtagcctcctcattgtggagacgatgaaacggagcatacagaccgtctcctgccaccctatgtggccgccagtccccggaccacagttactgggggctgcgaagtggctgtacgcgtagacaccgacctccgtagcagccctcgcgaagcccggatgcggggcgaccccgcgcgccctacctggatccggggatccacctcttcttcctcctccagcccctgctccatcccctcttcctcctcctcctcctcgtcccgggcaggcggcaggatttcggctggctcctccgagcggctccgcttcagtgccgcgtccatgcaggcagccggcacgcgcgccgcgcagtgggctccggagcgccccgggggtcgcggctgccacaggctgggctggagccgcctcgccacagccgggcacggtcggggagccgccggggccgacacccgggagacgcagctcgccgatgcggatacctccggccgcggcggagcagaggaaatgggcgcggccgccccctttctgccgcggcagtcagcgcagcgcccgctccgcccccgtcccgccccggcctcgcgttccgccgccagtcccagctatccaggtctccgtcgcaaaaccccagctccctccacatctccaaggtggcaaaataggacagcccccacccccttgtaacttagcagctcggatatatctcaactacgtaacgcaagcctcccgctttcgggagtcccctcctccagccctcctccgaggctcgttgtttgtgtggtagggaggcgtgggtgttttcacactgaagtcgccttctgaagcctacgctcagtgaccctggccctcaggaccaagacttgccgaaaccctatacccaaagcacactcatcctcttgagcgaaccttgggaatggcggaggttccgtgcactgatgcattgccgaaggctgcggcctctctgggcgagccccataccgaaacacagaggtgcggcggtcctacctgaatagccaggagcatggagaatgcattgagctgggatttaaggaggtggcaagtgtaacccctgttgatgggcacactctggccaagaatttatgaattagtgagactttctgcccaccatcaacaagtagggagacagagttggcctggcagacacagcatccgaaaaggccaaactgaagaggcacgtgtgtgtgcttttatgaaatgtcagggccactgtgatgtcaggggaacgcaaaggatgaccttggcaaagcagatgagcacatggctgctcacgtctccttgccttgagaaatgcagaacgtgcacatgtcctacacggaggcctgtagcccatcggctctgagtttggaggacaaatttgcttgagaaaggagcttctttctgagaacctatcatcaaagccaccttacaaaacctgggtctggcacaacgtggtggctcgtatctgtaatcccagctctttgagatgccaggacacaaggatcacttgaggccaggagttcaacaccagcctggacaatacagccagaccccttctcaaatgaataaatagtcctgctcctggtggttttatcagaaactaggctagagggttactccttgggcaaggcaccaccccatacacgctggcactgtagtccactgtcaaaggaaatttgtcctgtctcctggaggtagtgccatggtttgtttctaaaaaggtcagacctgttcattgctctttaaatcaaggatgagtcagcaattctgtgagaggtgcttcaaagctccttgctaaagacatagttgcttttggttttccaatgatagatgaagccaggaacaagatagccataggggtcactttggaacacaggagccaccaaccttctctggtggcttggaattgagcctccaactttgcaggtacatcctagctctgaatgaactgagagacagagtttgaaataaacagaactctggggtcagccctgactatgataaatgcttctcagctagcagaaccctatcctctccattctaaatggcaaactccaaactacattcctgcttaagcttaggtcaagagcaaaatacatctatgagacataggccaactgctcaagaacatcagttcagacttttgttgtcttattttttggagatctgggccagctatagtgttaatcctaatagtctttctaaagataaaatgagaaaaataaataaaccacaggcagtactatatacagtcaaccctccatagcctctcaggttccacatgtgtaaattcaactaaccacagatagaaaatatttgggggaaaaaaacacaacaattaaaaaaatgcatatttaaaaatacatggccaggagtggtggctaacacctgtaatcctagcattttgggaggctgaggcaaggaggatcactggaggccgggagttccagaccagcctgggcaacaaagcgagactgccttgctctctagaaaaaaaaaaaatacagtatatgacaactatgtacatatttgcattgtattaggtattgcaggtaagaaatctagagctgacttaaagtatacaggaggggctgctcatggtggttcatgcctgtaatctcaatactttggaaagccaaggtgggtgggttgcttgagctcaggagttcaagaccagcctggacaacatggtgaaacaccatctctacaaaaaatacaaaaaattcgccaagtgtggtggctcatgcctgtagtcacagctatttgggaggctgagatgggaagattgcttaagcccaggaggtagaggttgcagtgagctgagattgcaccactgccccccagcttaggtgacagcaagaccctgtctcaaaataaatatatatatataaataataaagtatacaggaggggccagatgtggtggctcatgcctgtaatctcagtcctttgggaggccgaggcaggagagacgatcgcttgaggccaggcgtttgagaccagcctggacaacaaagcaagacctggtctctaggccaggcatggtggctcacatctgtaatcctagcactttgggaggccgaggcaggtggatcacctgaggtcaggagtttgagaccagccaggacaacatggtaaaaatacaaaaattagctgggcatggtggcacatgcctgtaatcccagctactcgagaggctgaggcagaagaatcgcttgaacccaggaggcagaggttgcagtgaaccgagatgataccactgcattccagcctgaacgacagagtaggactttctctcaaaaaaaaagaaaaaagaaacacctcatctctaataaaaattgttttaaattagcaaggcatggtagcacatgcctgtagttccagctactctggaggctgaggtagatcacttgagcccaggaagtcaaagctgcagtgaccccgatcatgccactgtactccagcctgggtgacagagggagaccctatctcaaaaaaaaaatgtttttaatgaaaaaataaattaaataaagtatacaggaggttgtatgtaggttatatgtaaacactgccattttctacaggggacataagcatctcagattttagcattgcaggggtccagaaaccaatcccccagggatatcaagggacaactgtatatattccctattggcacatatgtagtgcacataaatgcatagcaaaaggcctggaaggatttatacccagtaaagagtggctacctctgggaaaaagggagcagggcgtggcctaggattgtctgggatgggggcaggggatcaaaggaatgttagtttctcagtaatgtttttatttttcacaaggaagatatgtttatgattgttttgtggaatttaaagataaatttaaaataatgcatactggtcaggtatggtggcttatgcctgtaatcccagctactctggaggctgaggcaggagaatcacctggacccaggaggcagaggttgtagtgagccgagatggcaccattgcactccagcgtgggcgataagagtgaaactccgtctcaaaaaaaagaaagaaagaaatgagaaagcgtaccacatatacttttgggggaaaagcactccagagactgcagcagcatgtgcaaaggtcctgaggtgggaatatgccttgggtgttggcaaaaaagcaaggagatccatgtgggtaggacagagacagccagggagagagggagggagatgaaatcagaggcaagcatgtgggtaggccacggagatgctttaggtcatggtaaggaatttggattttgttctgagtgagtgctcctgtaataactctggctagtgtatgagaaattgactcggtggacattgaggagctagggtcagaggagacaaaggagatccattagcctgatgatcagcctcttctgattgcttctgttttttcagcaaagtaatgagccacatcatcagctgagaatgaggggatgtggggcagagggcaatggaggttggaggagagaggctttgtgaaagagcttgcagggacagttggtgactgagttgaccatgggaatatattataatcgccaggttgcgctaaggacccacctatggtttgagagtcccagtgaacccagtcagcaaggacgagtggattttcctatagtatagtctccaaatcattcccatctttctaacccttgattcagggcttcatcatggctccctagactcttttacagtccctcaccctcttatgtccacacttcccatttgatctagcttagattccattgtccatcattaaaatcaccacactacagtcaaccacaactccctcacgcttctccccgaccactgtaagcacttggcataatcccaaccctggttcaatcccacagtcttactactttttacctgtacttagtagctaagctaaagtgctggaattataggcgtgagccaccacactcagccaaagagttggggttttttttagtttagtttttttttttttttttttttttgggacagagtcgcgctatgtcacccaggctggagtgcggtggtgttagctcactgcaacctccgcctcctgggttcaagctattctcctgcctcagcctcctgtgtagctgggattataggcgcctgccaccacacccagctaatatttatatttttagtagagatgaagtttcaccatgttggccaggctggtcttgaactcctgatccacccacctcagcctcccaaagtgctgggattacaggcgagagccaccgtgcccggccaagagtttttatttaatgtttttaaactgaagtttgcaagtgaaagtgatcaacaacattaattcatttgtatttttgttctgttttttgtttttagatctagatctgcagaaagcaacattaattcagtacacttttcagcccctactatatgcatacactatttctggggccagtttgagggtcccaaacatgtagatgacaaattcctagtcctttacttggggagacaggccctcatgaaacctgggccccaggccaggtctcacacctgtaatcccagcactttgagaggccaagggaggaggatcgcttgaggccaggagttcaagaccagcctgggcaacatagtaagagcctccccacatctctaccaaaaaaaaatttttaattagcggagtgtggtggtgtgtacctatagtcctaactacccaggagggtgaggcaggaggatcccctgagcccaggagctcgaggctgcagtgaactaaggaagtgccatggcactatagcctgggtgacagagtgagaccctgactcaaaaaaaaaaaaaaaaaaaaaaagtgccccaaagcagcagccaagtcaatccctcattgtgaagttaagaccctttctgtcaaatttcaatgccatttaaattaagattccttgcaatgccaatttttttttttaatgctttgtgagctaggcgtgctggcccacatctgtaatcccagcactttgggaggccaatgtgggaggactgcttgaagccaggagttcaacaccagcctgggcaacatagcaagaccccatgtctaccaaaaaatacaaaaactagctaggtgtggtggtgtgcacctgtagtcctaactactccagaggctgagatgggaggattgcttgcacccaggaggttgaggctgaagtgaaccaagactacactactgcattccagcctggacaacagatagggaccctgtttctaaataaatacattaaattaaattaaatgcttcgtaactacctgttaactcctagaacagaaactgctgtctggactaagaatgaatctgcattcacatcacactctggtgtcaatatcggaagaaactgataactagcatcccctctttctccaccagtgatatttacgtggcactttaggtcagaggctgcaaactggaagcgactggtgggatcaggcctggggtatgtgctgcctggctgacatagcctttataaatttgagccaacagttaaaactaacatgaaggaggcttgcagcagtgtggggtggggagggactcatgcatgggtgcgcagccaccacaccccacccccatcccttgcactagcaaggtcccccgaaaaaaaaaaaacctaaacatgaaaacagtgacctaatatgaaaatgcagacatctctgattggcaagagtgtggagaagatgtgaggagtggctggctggcccctttaggatggcatgtagtctcaaattaacctcagaaccctattggcagaccacttacacctggcaggccacacacaggtaaatgtctgacctctccccagagccctcatggtaaggtgttgcaggaaagctggctcgtaggtcttcctgccaaatctctcttctcttcccagcgacccctaaggatcatggcacatagcaaggtggaagagaattttaaggtagaccataaacccttcaacaatattttttaaccccaaatgactggttctaagaattcaagagtctatagaagccagttctttgaaagggatcagagcctccacattaaagaggcatctgtttaatttagcgattcagtgacatcagtgtgttgccaaattgtcttccaatgtggccactcccctctaaggagaacctttatttgtgtctaaattgaattaaacttgtctcttgacccagatgaattacaggccacagcacctagagaatccaggaaagagattttcagtgtatatctgtagtcttacaggacctacagatatttaggatggtgctggaatcctggagatggaaaaagtgttctactaaaaagaagagcccaggtgcggtggctcacacctgtaatcccagcactttgggaggctgaggcaggtggatcacctgaggtcaggagtttgagaccagcctgaccaatatggtaaaaccatctctactaaaaatacaaaaattagcctggcactgtggcatgcgactgtagtcccagctaccagggaggctgagacaggagaattgcttgaacccaggaggcggaggttgcagtgagccaagacggcgccactgcactccagcctgggtgacagagcaagactctatctcaaaaataaataaataaataaataataaaaagaagaaagagtgcttgcttcggcagcacatatactaaaattggaatgatacagagaagactagcacggcccctgcacaaccatgacatgcaaatttgtgaagtgttccataaaaaattaaaaaaaaaaagaagaagaaagatcctattgaagtgacggcctttgctaaaaaaaggggggaaaaagaagaaagaaagttctataccctgcaaatcaatgagcataacattttgcagacactattctagaatgggattttaaggaggagagaatacttctgtgtcccgagaagaaaaatgactcatcaccatgacccagcttgggttaaccaagaacaaatcatctcagcacagccctcacttccttatccatggcttattagtctaggaaatctaaggaaggaaataggcaagatagacaaagataaatggtacaggaaaaggccacttaaataaatccacttataaaggaagccaaaattccatattaaaatggtgaagaaaggtatttattaggactttactctggaagataaaacttaaaataatgttaagaaatttttcttgtattttaaaaatacaagaaatatttatttatctgacaagtatttattggccatctattatgtgacagcctctggcaagtgaaaatatgacagtgaacaaaggagacaaagcatctgctctagtggagcttatagtccaagggaagacagacaaatggttaaatacataaaaaagcaacataggccggcatggtggctcacacctgtaatcccaacactttgggatcacctgagatcaggagtttgagaccaacctggccaacatggcgaaaccccgtctctactaaaaatacaaaaattagccaggcgtggtggcaggcacctgtaatcccagctactcaggaggccgaattgggagaatcacttgaactccataggcggaggttgcagtaagccaagatcgcgccactgtactgcagcctgggtgacaggagagaaaccctgtctcaaaaaataaaaaaaaattaggccaggtgcagtggctcacacctgtaatcctagcactttgggaagctgaggcgggcggatcacctgaggttgggagttcaaaaccagcctggccaacatggagaaacctcgtctttactaaaaatacaaaatcagctgggcatggtggtgcatgtctgtaatcccagctattcgggaggctgaggcaggagaatcactggaacccgggaggcggaggttgtgatgagccgagagcacaccactgtgctccagcctgggcaacaagagtgaaagtccgcctcaaaaaataataaataaataaataaacaataaaataaaacctattataaaaaggctgctataaaagcacttttataaacctaaactcttccctggggcctcccaggccccacctcatctgacttgtgcccacatctcacacctcctctcaccgcccctcctcctcgctcaccctctggcaccacatgggctgtcagctggctctgtcctcagggcttctgctgtctgcatcgctatctcctccagggcacggctgcctgactccttctcatcatccacatctcagcccaaatgtcacatccatagcaaggctttctccaactcccatctggaacagtttgtcctccagccctctctatatagtttggctgtatccccacccaaatctcatcttgaattgtgtcatgggagggacctggtgggaagtgattggatcatgggggcagtttcctccatcctgttctcgtgataatgaatgagttctcacaagatctgatagttcataagtgtctggcatttcccctgcttgcactcactctgtcctgccaccctgtgaagaaggtgcctgcttctcctttgccttccagcatgattgtaagtctcctgaggcctccccagcaatgcagaactgtcagtcaattcaacttctttcctttaattacccaggttcaggtatttcttcataacagtgtgagaatggattaatattcctctctatctcattaccctgttttgttttcttcatagcaattatctttatcactagctagtctattttgctttttaatttttattttttatttttaaaaaatagagatggggtcttactaccttgcccagactggtcttgaactcctgggctcaagtgatccacccaccttggcctcccaacgtgctgggattataggcatgagccaccatgtccagcctttataataggttttataataagtttttacagttattataaaagtgatgggaagcactgaagggactgaattcaaagaatgacacagtcagtatatttgcttcagtgatcactggggctgctgtgtggacatgaaatggccatgaaggcaagagcaggagtagggatacaggtcagcaggctgtcccaggggccctagtgagagacgtggctgcctgggcttggggtccgatggtagtggggagatggactggagttgatttaggttatatttggaaattagctccaacaaaacttgcaattccatccgatgtgggggcagagggggcagaggcagagacatcaagaataactcaaaattttgacttgagcaagcagctgactgaagctgccatttacagagtgaggtatgggagacttaagaaacagttttgcaatcaagaagcctgttttcaggcacccaagtctgacaggctattaaacactcaagtggagatgtgaagtagacagtaggatagacgtctgaagctcaggggacaggccaagactgcagatataaatttaagagtcgactgcatgtagatgatatttaaagccaagggactgaatgagatcaagggactgaaatcacttagaataggggagatgtggaggaaaagaggaccaggacacagctctggggcgtcccaacatttagagattgagacttggaggggaagccaggcaagaggacaccagccagctgattcttaaaataacaataatcacaaaaatgaatcaatcaactgttgaggaattttttgcatatgtttttctggtaaaattatatgatcatataataaaaaattggtcgattcagatttgactttcacagcacaatcattaacagtgtaattttggcaaaaatagctgaggtctttgttaattttcccaggtgtctctcttacctctttgatattcaaatcattctcatttgaagtatctttttggtccttatcctcatagatttttctctcatctaatgctgctgtttcctcatatgtcaatggcttagcaaatgattagggcagttccccaaaattgctttcctaatctttttaaaaccttattttgcaagactgacagtttcactttgccatcaatttttatgtaatttatgttggcattgtgctgttgtaacctgacaactatagaggaaataatggacaaagactgtgacacaatgggcagcggtggaagcttggttttgaaaggaatggatatgtagtcagtttatgagtgattaattttgtgtcacaatgatgttagctgtctatagtggagataactagctgtccaccaaatccattctccccttccttaagcaataaaatcaacagcatttccctacctaccatttggctaggtgtggctttgtgacaaagtgaacagcagtgacatgccactttcatgcctgtctgacaaaaattgcctacatgtgctcctttgtgtgttttcctcttctttgactggatgcagatgacagtgagggccctggagaatgacagatttacaagatggagacaacctggatccctgagtgactgcatggaggatagcacccccaccaacttgagtaccctgatttcttgttacctgtgcgagaaataacattccatcattagagtcattaaacatttgagtctatttgttacggtggctcggtctatcctaaaggacacactgctctacttaacttcaggaacgggataatgaatactcaataatgaggagccccttatatatttcagcaagatatttattacttcatgtagactacactattactttgtgtagacaaggctgagaaacaaggatggttgctgacctaggtcagagaagtagtactgactgaaaaaccaaacctaaaggttaatgaatcactgtccaaccatatatattcctttgggctttattatcagttctgtccttttcaacatttgtagtaatgacttggatgaatataaagaatgctcacttcccaagcttgcaaaatccaccctggattggacaatcgtgattcacaaatatcttggcgttttatttgcattgtgttgttgtatcctaacaactatggagagaataatgaataaaaactttgacccaatgggcaggggacagaagcttggctttaaaagggaaaggtgattgcgccactgcactccagcctgggcgacagagcaagactccgtctcaaaaaaaaagggaaaggtggtgcacaaaactgaagatggtaaagatcactggagtaaactgtaaggtcctgagcttagtttgaaataaattagaacaagatagagaagacatggcttaaagcagcacattttttaaaagttagacattttagaacgcatttctacaagcattgtgcctataataaaaaggtgataatctcgtgtttttctgcctgtgaggggggacctccctcttgatattttgttgtcaaatgctacacaatacatgaaatgtgctcagaggagagtgctcagaactgagaagcctcaggaagatggatttggggtgtgtgtgtgtgtgtgtgtatgtgtgtgtgtgtgtgtgtatgtctgtgtgttttaatagagacagggtcttactctgttactcaggctggagtccagtgatgtgatcacaattcactgtaaactctaattcttggactcaagcgatcctcctgcctcggcctcctgagtaggtaggactacgggaatgtgccaccaattttttttgtagtgacaagggtcttcctatgttgcctagactggtcttgaactcttggcttcaaatgatcctcctgtttcagcctcccaaagcattgggcttacagacgtgagccactgcacctggacaaattttttaaaacattctattgggtaaatctgttcaattgttaattgggctgcctcaataagcagtgaatgccccatctctggaagtgtttgaataaatttgcatataaaattactgttattcagtcattttaatctacaagaatggcaatttcatatggttcaacctaatatttggtggaaaaggtagaggatgagtcaagcaattgatattttaagagcaagtgacagaagcacatctcaaactgacttcaccaaagggaaggagaggtatttattagtggagtggaaagcatattggctcgtgtaactgaaaagctcaagtaaatttagcttcgggtatggttacatccagcagtctctctctgtctctgccctgtcctcctctgtgttggctcccttcccagacacacctgccccttgtgctaagcagctgggcactagcggctccaggcttatgttaaagcagcttaacaaccccagctaagagtctctcctcaccaataattcctgggactaactcttattgaactgagttggctcatacactcctctctgaatcaataactaagccctcagttattgactcaggggcagggagtaaaattactaattggcttcgcctcaattacaagttgccctggagtccagaggagagtggggtgagaaaagaggatgttcagccacatgggctgaaagtaaagagagggtggctttccaatggaaaactgaggtgctacaggttgacctgaaaatgaaatggtgtgttggttctgaatctatttgaaaaataaataagtaatagaaagatgaagtgaaccaaccaagtgaatcaccgggtgaaaatgtgttctaagcagagagagcagctggtgctcatgggggaatgagctaggtaggtttgaggaacagaaacaaggtcagtgttccattatctgttgctgcaaaacaaaacgtcataaacttaatggctaaaagtaataactgttttatctcttcaattctgtaaaatgactagactcagctagaaagttctgctccatgtgatgctagctggctgccgtcacgtggaaggttgactaggctggaacatccaagatggcttagtcacatggccagcagtcaatgctgctggctgggggctcacctggggttatgtatggcccagggctcctcagttctcctccatgtgtcttctctgtgaagcttttggtttcttacagcatggtagctagattccaagaaagatagcaaaagctgctaatctttttttttttttttttttttttttgagacaatgtcttgctctgtcgcccaggctggattgcagtggcatgctcttggctcactgcaagctctgcctcccgggttcacgcgattctcctgcctcagtctcctgagtagctggactatgggcgcccaccaccaagcccagctaatttttttatttttagtagagacagggtttcactgtgttagccaggatggtctcgatctcctgaactcgtgatctgcccgcctcagcctcccaaagtgctgggattacaggcgtgagctaccgcgcccggcagaagctgctaatcttaaagcttcagctcagaagtcctgaaacattaatttaatcacacacaatcatggagccagcatattcaaaggccattacattagcgtataggaaggaaagaaactggtggccaccatcttggctccagccttggggagtaggaggctgggccatagtgaagggcagagtggtatgcaatggaattggaaaggtaggaaggggctggatcaggggtatggaaactataatccagaggccaaacccagcccactgcctgtttttgtaaataaagttttattggaaagtagccacattcatttgtttactatattgtctatggtagaatctaatagcagaatcgagcagttgcaacagagaccatatggctcacaaagcctgaaatatgttctatctggtcctttacagaaaaatctactgatgcctgggctaagtcatggagtgccttataagaattgttgaggagtttgaattttattctaagtgtgatgggaagccaccagagggttttaaaccagtgagccacaatatcccacctacatatttaaaagatcctctctgggaatggattactggaggataaacatgaaagccgggaaaccagttagcagactatgacaataatccagatgagagatgatagagtcaaaaacacaagtgtgtgaattttgcacatgtattcaggagaagcagcctgcaggacttactgagccattggatatggggatgagaaaaagagaggaagcaaggatgacttacatttttggcttgagcaactgggtaaagggtggtattattaactaagaagatgacgatcaggggaggagcttattgggagaaaaagcaccaagagtttttttttttgaagaccgagtctcactttgtcatccaggctggcgtgcagtggtgcgatcttggctcattgaagcctctgtctcccgggttcaagcaattctcatgccacagcctcccgagtagctgggattacaggtatgtgccaccacactcagttaatttttgtatttttagtagagaccaggtttcaccatgttggccagactggtctcaaactcctggcctcaagtgatcccctcacctctgcctgccaaagtgctgtggttacaggtgtgagctaccacacccagccaagagttctttttcgaacataccaactttgaagtttttgtcagatatccaagagacctgacaaaaacctcaaagttaatatgttcaaaagcagctgaacacttgagactggagatcaaggcataagtttgagaatcatcagtaaacagtattgaaagccagacacctggaaggaatatttccagagaaaaaaatggagatagcctaagacctgggaaaattagaagccaacagcagcagaaagtcagcaaaagagaagcagtagtagtggagaggagagaaccaggagactgtggtttcatgaaagtcctggaaaaaacatttcaagctggagggagtggtccactgtgtctaatgctactgggtagtggaagaacgggtggacagagaagtgaccacagaactctgtgacacaggcctttctgaaaccttgaccagagcgatttcagaggacaggaccacaccctgattgacggagtttaagaaaaccatgaaatgtggacaaatggaggcagcaaatatagagagacctattctgagaagttttgctataaaatgaacaggtcagaatcacagatgttcactgcaggctcatgagctttaaagtctctttcactactaaagagcattgactccatggagcacctactatgtaccagcacattgcttgtcaaggatcccaaagaggaatttctttctaatggcttattgggaaattggatgaaacacaacagaaatacatacctatagcttccaaaaaaaaaaaaaaaaaagagaagaaaatttcagcccttgaaaggcaagtgaagattttcaaacaggtttctccacattgtagggagacctgcaaacccataaaaccagcagtttcgtttctgctgggtatgcactcaagctcttccttccacactttctcaaggaagcttgttcaagcaaacttctgaaatttgctaccaaatataaatgtgcaacccaatgaataagcagatttttgtaatcagaacaaaatgcatcttgtagaaggatacaaagtattatttttgctttaacattttgttatttgtttctggaaaacatttagtttctcctgacaaacttccaggacaaaagcacacactcatacacacagaataagtacagactgtaagaaagacatggagacaattttgtatctaatttcacttcctggtaatcttcaggaagattcaggtgatctgaatctgaatctctacctataatcttcgggtggagattatcacaccttgggaggcctaggcaggcagatcgattgagcccaggagtttgagaccagcctgggcaacatggtgaaaccctgtctctataaaaaatacaaaaattaggcgggtatggtggtgcatgcctgtggtcccagctacttggaaggctgtggtgagaggatcatctaatcccgggaggtcaaggctgcagggagctgagatcatgccactgcactccaggctgggcaacagagtgagaccctgtctcaaaaaattaaaattaaaaaaaaaaaaagagatcacctgaccctaaagtctgagctctgaaccattggctatactattttatagaggtgcaagctgactcattatgttgcctgtcttcctgggtctataaaatatgtaatcagcaaagacatggaatcagcctaaatgcccatcaacagtagagtggataaagaaaatgtccaggttcggtggctcatgcctgtaatcccaacagtttgggaggatgaggcgggtggatcacctgaggtcaggagtttgagagcagcctggccaatgtagtgaaatcctgtgtctactaaaaatacaaaaattagccaggcatggtggtggacgcctgtaatcccagctactcaggaggctgaggcacaagaatcacttgaacccaggaggcagtgagccgagatcgcaccattgcactccagcctgggtgacagagtcagactctgtctccaaaaaaaaaaaaaagagaaagaaaagaaaatgttgtacatatacaccatggaattctatgcagccatgaaaaagaatgagatcatgtcctttgcagcaacatggttggagctggaggccattatcctaagtgaactaacacagggacagaaaaccaaatatcacatattctcacttatatgtaggagctaaacactgagtacacatgaacacaaaaaacgcaacaacagacaccggagcctacttgagggtggaagttgggaggaaggtgagactcgaaaaagtacctatcaggtactgtgtttactacctgatgaaataatatgtacaccaaacccctgcgacaggaaatttacatatgtaacaaacctgcacacgtacctctgaatgtaaaataaaagtttttttttaactttttcagagaagtaaagaaacagaagaatgactactccatagagcagccaacttttttttaaaaaaaggcatatatggaatcataacaggagccatatttctgtctttgcccatgaatttatttagaatcccagctaatatggtttagatatttgtccctgcacaaatcatatgttgaatgataacacccagtgctggagatggggcctgatgggaggcgtttggatcataggggcagatgtttcatggcttggtgttgtcttcatgacagtgacttctcacaagatctagtcatttaaaagtgcatggcacctcccccacacatgctttctctctcttgctcctgctttcaccatgtgacatgcctgctccctctttgctttccaccatgattcgaagctccacaaggcctccccagaagcagatgccactatgcttcctgtagaacctgcagaaccatgagccaattcaacctcttctatttttaaaataaattaccgagtctcaggtatttcttcatagcaatgaaagaatggcctaatacagaaaattagtactgaagagtgagtgattgctatataggtacctgaaaatgtggaagagactttggaactggctaacaggcagaggttggaagagtttggagtgctcagaagaaaacagaaaaatagagaaattttggaatttcttagagactggttaaatagttgtaaccaaaatgccgatagggatatggaccgtggagaccaggctgacaaggtctcagatggaaatgaggaacttattgggaactggagcaaaggtcacatgtgttatgccttagcaatgagtgtggctgcagtctgttcatgtcctagggatctgtggaagtttgaactaaagagtgatgaccgaagctgggtgcggtggctcacgcctgtaatcccagcactttgggaggctgaggcaggcgaatcacaaggtcaggagttcgagaccagcctggccaacatggtgaaaccctgtatctgctaaaaatacaaaaaattagctgggtgtagtagtgggtgcctgtaatctcagctactggggaggctgaggcaggagaatagcttgaacctgggatgcagaggttgcagtaagccaagatcactccactgcactccagcctgggcaacagagcgagactctgtctcaaaaaaaaacaaaaaaaaaaaaacaaaaaaaaaaagagtaatgacctagggcatctggcagaagaaatttctaagcagcaaagtattcaagaagtggcttggctgcttctaacaacctaggctcagatgagggagcaaataaatgacctaaagttggaatttatatttaaacaggaaatggagtgtaaaagtttggaaaatttgcagcctggccatgtggcagagaaagaaaaagctttttcagaaaaggaattcaagcagcctttggaacaactgcttgctagagaaatctgcataactaaaagggagccaagtgctaatatccaagacagtggggaaaaggcctcaaaggtatttcagagaccttcttggcagcccctcccatcacaggcccagagtccagaggcctgagaagaatagtgtcatgggtctgggccccactgccctgcacagccttgggacactctttccacatccaggtgctccagctccagctgtggttcaaagtggcccacatacagctcaggccactgctccagagaatgcaaactctaagccttggtggctttcatgtgttgttaagcctgcaggtgcacagagtgcaagaatggtggtttcttggcagcctctgcctagatttcagagaatgtatgggaaaaggttggatgtccaggctaaagcctgctgcaggggcagagccctcacagagaacttctgctagggcaatttggagagaaaatgtggggttgcaggccccaaacagagttccagccaggacactgcctagtggagctgtgagaagaggccaccatcctccagaccccagaatggtggatgcactggcagcttgcaccctgtacctggaaaagccacaggtactcaactccagcccacgagagcagtctcagaggttgcacgctgcaaagccatgggggcagagctgcccaaagccttggcagcccactcctcataccagtatgccctggatggtgaacatggagtcaaaggagattattttggagctttatgatttaatgactgccctgctgggtttccaacttgtgtgaaaactgtagcccctttcttttggccaatttctcccttttggaacaggaaggcttacccaatacccccactatatcttgcaagtaactaacttgttttttattttacaggcttataggtgggagggatttgccttgtctcagatgagactttggacttttgagttaatgctagaatgagttaagactttgggggactgctgggaaggcatgattatattttgcaatgtgagaaggatatgagatttgggaggaaccaagggcagaatgatatagtttggatatttgtccccacccaaatctcatgttgaattgtaatctccaatgctgaaggtaagacctggtgggaagtgtttggatcatggagacagatccctaatggcttggtgctgtctttgtgatagtgagtgcttgtgaaatctggtcatttaaaagtgtatggcacccccgcctccccaattctctctctctcttgctcctgctttcaccatgtgacacctgctacccctttgccttctaccatgattgaaagctccctgaggccacccccaaagcagatgcctctatgctcactgtgcagcctacagaaccacgagccaattaaacctctttttaaaaaaaatataaattacccagtctccggtattttttttttttttttttttttgagatagagtctcgctctgtcacccaagctagagtgcaatggcgtgacctcaggtcactgcaacctctgcctcctgggttcaagcgattgtcctgcctcagccttctgagtagctgggattacaggtgtgcaccaccacgcctagctaatttttgtatttttagtagagacggagtttcatcatgttggccaggctggtctcgaactcctgacctcatgatccgcccacctcagccttccaaagtgctgagatcacaggcgtgagccatgtcacctggccaggtatttctttatagggatgcaagaatggcctaatacaccagctctgctctttatgaagctatatgactctaaatcacttaatctgagtgagccacagttgcttcatttgtcaaccagtgataatagatctactttacatttgtgtattaaattagcaaatgtagataaaggtctgtgttcatgctctgagtacaatacatgatagttatcataaagaacaatatctatgagtacacccagcctttctcaaaaagataaagctatgttatctactgttaagaagggtctcaaaaaaaaaaaagaaagaaaaacaagaagggtcccagatctcctgagttatcctacctcatagtcaggattgcctgtctatccattttaagaataatcttggctgggtgcagtggctcacacctgtaatcccagcactttgggaggccgaggtgggcagataacaaggtcaggagtttgagatcagcctggccaatatggtgaaaccccatctctactaaaaatacaaaaattagccaagtgtggtggcaggtgcctgtagtcccagctactcgggaggctgaggcaggagaattgcttgaacccaggaggcggcggttgcagtgagcgaagattgcaccactgcactccagcctgggtgacagagtgagactccctctcaaaaaaacaaaacaaaagaataatcttggctgggtgtagccgtttatgtctgtaatcccagcagtttgggaggctaagatgggaggatcacttgagttcaggagttcaagaccagcctgggcaatatagcaagacctcatttcttgctaaaaactttaataaaaaaatagcgccgggagtagtggctcacgcctgtaatcccagcactttgggaggctgaggtgggcagatcacgaggtcaggagatcgagaccatcctgactaacacggtgaaaccccgtctctactaaaaatacaaaaaattagccaggtgtggtggtgggcgactgtagtcctagctacgcgggaggctgaggcaggagactggcatgaacccaggaggcggagcttgcagtgagcagagatcatgccactgcacttccagcctgggtgacagagcaagactccgtctcaaaaaaaaaaaaaaaaaaaaagccaggcatggtggcacatacctgcagtcccagctacttgggaggctgaggtgggaggatcacttgagcctaggagatcgaggctgaagtgagctatgatcacgccgctgcactctagcctgggttacagaacaaaatcctatttcaaaaaaaagaaaaaatgatcttgctgtctggggaatcctacagtaggcagtataattttaagcaagtacccttgaaggtcacagactttagttattttgttatttatttattgttaagaaaggatcttgctctgtcgcccaggctggaccgcagtggtgtgatcatagctcactgcagctttgaacttacggattaagcaatccttccacctcagcctcttaagtagttggcattacaggcacataccaccgtgtccagccatttaaaaaattttttgtagagacagagtttcactatgttacccaggctgatctcaaatccctggcttcaagcaatccttctgccttggcctttcaaagtactaggatgaccaggtgcgaatcaccacgcccagctgagagtcacaggcttcagaaggtcatctgtcggcatagtaaagtgtctcccataaatgggatcacaaggccttctggctaagcaaccccaacctctcctctacccagtcccaaacctcgcagcagtcatccagacttgctttggttgccctataagtccttcccaatgagttatttctgattaggaagaacttctactctcctcttctctatctttgaagacattgggaactgctctactgtagaaataactacagtcccaatttggaccagtttgcagcttggctttgaatgttttcaaaacctcagcttagacaagaggaaaaaattctgtctccaagccttgcccacctcaacttccttaaagactctgacgaagagtgacaacagggctaggaatgaccatctttttggtctgactttagctggtgaaattcactgtacatagaaatgcaagagctggaagaggaggaactccagtggaaagggtctttccattggccctgatgatgcacaagctggctttgagcatcccatcttcttgatgtgaagaaacagcagcagaagctctatcaggtcaaggggctgtttccatttttaaatgtttgaggtttttttgagttgggtaaagaagatagctttaaattcctattcatgaatagcagcagatgctgtttggagtgtagaccacttcccctcagcctgactagggtttcagctgcagccagagtggacattctccatgcacgctggcagcgcccacctcaggcagctgtggagtccctcaacttttccaactcaggttttattggaagcttcagtagttcacttagtccatacacagagcagccctaagtgcccgggcatgtcaacactcccaatcattggaggaataagaaaccagtgggggaaggccccagcctctggcccttcagaggcacaattctgaggtgtattctccacaggtctccagcaacagtgagccctggctgcccgcaacaggaaccagtggaatcctacatccttgcctggcctatttctcctcttactctccctactcctcctcttactctccctactccttaactcctacttcctagggtcccctttcaaaaagctatctatacccaagacccaggtctttctgagatttcgtctttgggataacctaagctaagatatgcatcaatgcacatgttaggaggtgagttttaaaaaattttttttcttttttttacttttttcctctttttttttttctttttcaaccatgggagactcactggagtctttgtttctgaattaaaaaggaagtgtttggggtttttttttaacattcagaaataaagttgctcctggaaaagggaacctgtcactattaagaagagctgtccttcatgtggaagaagtgggaattcagttctgactattggtaacaaagttaagccttcaggctgactgttaatctaggccagggcctgggctggagaggagcagcctggctgattgtggtgtggaggtatttcttcttcccggtcctagcgctggaggctggaggtggaatgtgtaatgggaaaaggctgtgggttgagactgagacaaatgttgaaaacagatcatagagacctgggaaacctgaactgaggttacagagtaagagaaaaaaacaggcaagacaggcttatggagtgggaggtggtctggaatcatttcagggaccaagggtgaaggccaagggaaggccttctcccccttcctgacatttgtgcgagggtcctgccatggaacaatgcccctaataatcccagtagacctaataacaacacttcccccaactgtggatctatttgcatgagagaaggaaaacaaggggatgaagaggaggagatagggagatagggaaaacaagcatttgcgcccagtaagaacacctgctttccaagggcataattgtaacccagggaaaggaacaataaaacaaagactcaccgttaccaaaggggatttccaagaacaaaaacaaccaacaataactgagaaatcaatcacttgccttccttcctgctgacttttgttttttttttttttgagacggagttttgctcttgttgcccaggctggagtgcaatggcgcgatctcagctcactgcaaactctgcctctcaggttcaagtgattctcctgcctcagcctcccaagtagctgggattacaggcatgtaccaccatgcccagctaattttgtatttttagtagagacaaggtttctccatgtcagtcaggctggtctcgaactcccaacctcaggtgatctgcccaccttggcttcccaaagtgctgggattacaggcgtgagccaccgcgcccagcctcctgctgattttataaggctgtttttttaccattttacttagatatgtgggtctacagaggaggtgtagttatagtgtttctggggaagtaatatttttccagatgctacagccacagaccaatttttataataaactttattttatggagcagttttaggttcacagcaaacttgagtggaaagcatagagcattccaagtatagaggcttagggtatagagatgtacccctgtccccaaacatggacagcctccactccatcaacatcctgcagcacactggtgcctttgttacaatccatgcacctacactgacacatcactatcacctgaagtccatagtaccttagaggtcactcctggtgctgtatgttctatgggttttgacaaatgactgttacatatccaccattatagtgtcatacagaatagtttcgccactttaaaaatcctctgttctcctgcagagtaattttaattccacaagaaagctgggcggtcagctacaagtacaattgtcaaaattggatggtaaataatttttagcatatatcagactctcctggaattgatagcagattggaacccaccaatatagctgcagaataagaatcctgactgggactgggtgtggtggctcacgtctgcaattccaacattttgggaggctgaggtgggacgatcacttgagcccaggagttcaagactagcttgggcaacatacagagaccccatctttacaaaaaatacaaaaattagccacgtgtggtggtgcgtgtctgcagtcccagctacttgggaggccgaggaaagaggatcatgtgagcccaggagttggaggtttcagaaagctatgatgacacacacacctatacttcagcctgggtgacagagtaagaccctgtctcaacataaaaataattttaaaaaaagaatcctgactgtacttcaaatggtcgcattatccaaaagtggacaacctctatcccactcccaagcaaaccaaatcaaaaaagcccatcaaagaccccaagattttcccaaattgtaggtctttatctgtgacattgtaatttctaccatctaatactagtagctttagttcaataattataataatcagatcaggctgggcatgctggctcacacctgtaatcccagcactttgggaggccaaggagggcaaatcaactgaggtcaggagttcaagcctggccaacgtggtgaaaccccatatctacaaaaatacaaaaatcagctgggcatgatggtgggtgactgcaatctcagctgctggggaggctgaggtgggaggattgctcgaacccgggaggcagaggttgtagtgagctgagatcacgctactgcactccagcctgaccaacagagtaagactccgtctcaaaaaataataatcaggtcaactactgtagactatcacagctgtctttttgcaaggatgggatgcagtttcctgataaaggatataacctttcatcttagttaaaatcctttcttcataattctgagtctcaaaatgcttttctgcaatgttaatttccaacacctgctttatgagccgaccatagcaatttaactcccaagacctgaaaatgaaactcactgagtacattaaaaaaaaattatcaggatcatgtgaaaaactaattttttttttttttttttgagacacagtctcacgctatcactctatcatccagactggagtgcagtgacacaatcatggctcactgcagcctcggcctcccaggctcaggtatcctcccgcctcagcctcccaagtagctgagactacaggaatgtcccaccacaccaagctaattttttttttaaaaattttacagagacgaagtttcgccatgttgcccaggctggtctcaaactcctgggctcaagtgatccgcctgccgcccaaagcgctgcaattacaagcatgagccaccacgcccagccgtgaaaaattaattcttaaaaaaggtaaggatcagcgttgagtgtgcatttacagaacagaattcaacagatacctttgtttctttttttctttttctttctttctttttttttttgagagagtctcactctctcacccaggctggagtgcagtggcgcgatctcagctcactgcaacctccaagttcaagtgattctcctgcctcagcctctcgagcagctgggactacaggcgcatgccaccacgctcagctaatttttgtattttttggtagagacagggtttcaccacattggccaggtgggtctcagaattcctggcctcaagtgatcctcaagcctcagcctcccaaagtgctgggattacaggcgcatgccaccacacctgcctaatatctgtatttttagtagagatggggtttcaccacaatggccaggctggtctcaaactcctgacctcaagtgatccacctgcctcagcctcccaaagtgctgagattacaggcgtgagccacacacctggtctacaatttttttaattaaaaaaaatttgttttggctgggcacagtggccacctgtaatatgagcacttcgggaggctgagccagaaggatcacttgatcctgggaggtcaacactgcaatgagccatgatggtgcaagctgcacttcagcctgggcaacacagcaagaccctgtctctacaaaataaaaataaataaaaaatttaggggcatgatggcatgcacctgagtcccagttacttaggaggctaaagtgggaagaccccttaagcccaggagtttgaggttatggtaagctatgatcacaccactgcactccagcctgggcaatagagcaagacctcatctctggaaagaaaaaagtgtatctgtggctcccattgtatttctgttggacagtgctgctgctatttgtctatatagtaagtactcaggaagacaatttgttggaagaaacatcaggaggccatttttttttttgtaatcccaaagtgctgggattacaggcatgagtcaccgtgctcggcccttttttttttttttttttagatggagtctcactctgtcaccaggctggagtgcaatggtgtgatctcagctcactgcaacctccgcctccttggttcaagcaattctcgtgcctcagcctcctgagtagctggggttacaggtacacaacaccatgcccagctaatttttgtattttagtagagatagggtttcaccatgttggccaggctggtctcaaactcctaatctcaagtgatccgcctgcctcagcctcccaaagtgctgggattacaggtgtcagccaccacacgcagcctcagtctctcttttaaacagatttattgtataatgtatatatcataaaatccagtttggtgagttttactaaatttattgtcatgcaaccatcaccacatttctgtttaagacaatttcattgccctaaaaactttccttgtgccatttgtattctatccctgctctcagccaccactaggtaactcctgatctgctttctatatctatagttttgtcttttctagaaatttcatataaattagatcatacaatatgtggtcttttgtggcttctttcactttagcatattgtttttgaggttcattcttatgcactgtgcttttcttggcagtctcaatttttcagcctacttttagagaaaacaaaaatgagtggtagaaaatctggggaaattcctcagtaacttgatctgagcctagaaaagttgccaaggttaataaaaaacaccctgaaagttccatgtcacactgggattgattttaaggatactgctcatctctctttcctccttgtttttaaaagaaaattgactgtgttggcaaaagtactcatttcctcattttaccttcctgttcttgtctataaacttacataatttatacattatgtactcatagtgtagatacaaatgtggcattctgtatttcattttctttaccataaaatgtttttaaaagtaatgatcataaacttgctgaccagcatgcacactctcacctggaaaactgaacagaggtaactgctttttatggaatttaacaagacagtcattcatttatttaacaaaatgcaagctcttacagctctactttatactgaactctaaccagatgaatctaacatcccacggtcctaagattttgcattacaagtcatgctatttgtttaaataacaggaaaaaaaaaaagacagaaacactttaggaagccaattttccttgctaatgagcagatactaaaataatgagtatcttctgactaccttcctcaaaccactgaaaagtttacccattaatcatatgtgaactttgaagcgtgggtggctggagcttctcataagcacatccttaaagatgaaaccacatataaattgctaaaggaatcacccggtgaaagtcagactgtgattagtaggtatggggaggaaggagaagttgaaagacccaggctggggtcaaacctctttcagttacgtttttaatcaaattaagtcaaaactaacgtttcatgtctcttttgcttattattgacagccgtgtttagctcagccatcccccactgaagcgaactgtgtcagtgcactgtcagatgcagctttggaagacaattgctgtccctgctggcttcttccctcacgtgcctgtgtttcaatgcctgagggctcctctgagcccacacacaggactggccagaattgctgggaggtaacaccccaggacagcctcaacagatgagggctaggagctggtgagtccacccgccagcctcctcaccgctgcacagtctctcagaggggccttcacaggactgcggcccagttgtcctctgaggtatcctgctcggcaatgtgccctatgtggcttttctctcttccctgtctcacttccttactctgcctcctagaatcatttcttaaatagatgatttgcccaaaatcctttgcctcagggtccacttttgggctaaccgaactaagacatctacaaaattttagataggaatagactttaaagggatcctttgactttttttttttgaaacagcatctcactctgtcacctaggctggaatgcggtggcgtgatcttagctcactgtaacctccgcctcccaggttcaagcaattctcctgcctcagcctcccgagtagctgagattccacacgcctgacatcacacctgactaatttttgtatttttagtagagacagggtttctccatgttggccaggttggtcttgaactcctgacctcaggtgatccgcccgccttggcctcccaaagtgctgggattacaggtgtgagccgctgtgcccagcctcctattgctactttttaacagaaatctctgtgtctgactcagacccagagaaaagaaaccacagtgatcagagtcatacacaagggggtgccctctagcaggttcgcctgaggttgtccgcctcccgcctcatgctattaacattccataaacacgccatggcagagagcagggcactgctgaaggtttacatgcggtaactgatttcattctcacaacaaccacgtgagatgagtgctgttactgtcctcattttacagaggagaaaccgagcatttaaactaatttgaccaagggcatagggctagaaaggtggtgtttaagaacatcccagtgctttctagccctttctaatccaagggctagaatgctggaattgggattccagcccaggcagcctggttccagattcaaggacacagccctgagcatgtgagggtatctgagagctgcctgcttgatttgggggttaccatgtgtagagaaaggaaagaagatggtctatgtaacatcttcaaatgcttgaaggctttgagcaatgaacctccttggtggttgggtgaagaattctataatgagtggattctttcccagaatagtacttttttttttttttttttgagacaacttcttggctctgtcacccaggctggagtgcagtggtacaaacacagctcagtgcagcctcgacctcccgagctcaaacagtcctcccaccgcagactcctgagtagctgggatcacaggcacgcaccaccacaaccagctaattttttcattattattatttttagtagagacaaggtcttactgtgttgcccaggctagtctcaaactcccggactcaggcagtcctcctgctttggccccttaaagtgttgggattacaggcatgaaccaccatgcccagccagaatagtatttttaagtgcataaaagaaaacacataggattacaaaggaaaccaattatactgaaatgcacttatcaaaatgttcccccaaactgtgacacagcaatacagtgctcctttggtatacacagggaactggttccaggacccctgagtacaccaaaatacctaaatctgggcatactcaagctctgcagtcagatctgcagaacctgcgtatacaaacaggcctccatttacaggggtttgcatctcatgaacgctgtattttccatccacaatgggtggtaaaaactccacggttaagtagatctgtgcaattcagagctgttatccaaatatccaactgtatatgcatccattctatgggagtgattacacgtgagaatgggctccataaaagtgtcaattctctgtcattagacactgacaggaataggctgagttgaccaaatggctggatgctttcaagatagacatcagaggcaacctccaccttcattaactttctgtttctttttttttcttttgagatggagtcttgctgttgggaaaagctgagtgttgggagaagctgaggcagggcttgcacgtctgacataatgtaaaagagtcttggaacgtgtccagggtccatggtctaaaactccttgtggcctttggaacaccaagctctgtgctaaagggtggaaggctgccctggcacaacataatctaagcccagggcataaaatccctcatggcttggatagactccagggctcgtggctctggaatgtgtctagacttgctggctccttgctcgttgctctcccaggatcgattgtatcttgagttaaaagaacctgctctccattatctcaagtagcagagcaaatgctaaaccatcacagctgtaaatcatgtgcttaatgcaacgcacccttttgacctccacattctcaccacctgtttctttgttggattaccaataaatagtgtgggctcccagagcatggggcctttgcagcctccacaatcgcgatggtcccctggtcccactcatctctctcaaactgtcttttctcaatcctttgactccaccggactttgtcacccccacgaactggtgttgggtctgatcaccccaacacttgctctgttgcccaggctggagtgcagtggcgccatctgggctcactgcaacctccgcctcccgggttcaagtgattctcttgcctcagcctcccaagtagctgggataacaggcacctgccaaaacacatggctaatttttgcatttttagtagagacagggttttgccatgttggccaggctgatctcgaattcctgacctcaagtgatccgcccacctcagcctcccaaagtgctgggattacaggcatgagccactgcgcccagcctcaccttcattaagtttctaaaacaactttgtgtttctcaccaattctaagtctgtctatgcctgccagccattgtccctgataggaagtgtagggtgtccaagatgacattcaaggcccatgtgacttgaacccaataatttaccttaccgttgtgccgaactcctatccactccaatggggatagccccaggctcaagagaccaaagaagagacctcgagccagcaaatgagacatggggctttactggggccttacatacagggaagagagcccagtggtggtgggctggacaggagaaccatcaatcacttacggaaagcacatggcttatgtatcattttcactcggcaccctccctcaacaacctccacctggcaaccttcacatattcccaaaacaaagggctttgacccctgtacatcccagatccatgggataggccagggctcagatgttccttagagataaggaatgaatcttcaggttggccacccctggattccttggctcagaactccaaactgcattcaggtgcatctgctatacagagtcattctcagggtttgctgacgttattgccatcaggtgagtttaccatgcacttactaacctctgagcagtgcctcccatgttccctacattccagtcacagcaaaagtcctgcttccctgcatgtaccatgcactttgcatttcagcggctctctgccccctctgcctgcagtgagtgaggcctccatggcaaagtccttccttcagctgaaatggttttcaaagttccccgagagcccctatcccagacagaattaatcactcctcctctgagctcccataactcttcccacacgcctctactctagtgtatacattctagtatagttattgtgaacatatattagggcctacgacatgagcaatattttattcatcttaaataggatagggcagaatacctagcccaagacttggcggggcacggtggctcacgcctgtaatcccagtactgggaggccaaggcgggcaaatcacttgagctcaggagtttgagaccagcctgggcaacatggtgaaaccccatctctaccaaaaatccaaaaattatccgggtgtggtggcacgtgtctgtggtcccacctactcaggaggctgaggtgggaggatcacttgagcctggaaggcagaggttgcagtgagctgagatcacaccactgcactccagtctagacaacagagcaagactctcaaaaaacaaaaacaaaaacaaaaacaaaactagcccttgattggggtgtggaagcgagtagttcatttgacacaagtatgaaattagctgtatggagtgtctcaatagttaccccaggtctttgggagtctggtaacagtcttcatcaaaatggaagacttgtgtttattttaaaatgtcatgtatagctgctgtctctctcataatgcattaatgttaatgaaataatgttattggctttgcccaaatttttaagtaaaatggatatgccttaaaaacctatcttcttttttctgtggcttcttatgccctctggcctgccaataatcccgtggtagaggtacccaggctgagatgcagggaactagagtgttcctcttcctgaccctggagctaagggcatcatttggttggctttaactaagagtcccaggagaaccctcctgattgcttgagcccaggagttcgagatcagcctgagcaacatagtgagactctatctctaccaaaagaaaaattattttttataaaattttttttaaaaatagagatggcatctcactatattgaccaggctggtctcaaactcctggcctcaagcgatccacccatctcggcctctcaaagtgctgggattataggcatgagccaccacgtccaacctataaaataatttttaaaaaaaattagccaggcataatggcacgtgcctatagtcctagctactcagaaggctgaggcgggaggatggcttgagtccaggaggttgaggctgcagtaagctgtgatcccaacactgcactccagcctgggcatcagagtgagactctgtctcaaacaaacaacaaattttaaaaaaatcaacaaatgtaaaatttgaagaaaaaaaaagaaccctcctacctcccccaggcagctggatgctaaatacaaagcctctggcagggctctgccttccagtaaagagttcagatgagcaaggattccaacacctatccattttttttccccctcagacacactttatcatcatgtaaagcctatccattttctaatcttactccaaattcttttggggatgactcattctgtgaagtgagcttgttgggggttttccatcatgtcccttcgtgtttattattttcataatttgttcattgttgttgagactttatcttccctgacatatgcttttcttcttgtccttacaggacagacctctctcttctttgcccaaagaggggctgagcaagtgtccaagctcttcccttctgttagtttttgtctttttcctttttgtggagaacagggtctcactgcaaccttcacctcctgggcttaactgatcctcccacctcagcctcccaggtagctgggactacaggcacgtgcctccatgctcggccaatttttgtattttttgtagagacagggttttgccatgttgcccaggctggtctcaaactcctgggctcaagcaaacctcctgcctctgcctccctacgtgttgggattacaggcatgagccactgcaccctgccttctgttctgtttgagtttgatctgcctctgtaaatttaaactatggtgctgggcaaaaagcatggaattttgagtgaagcaggctgctttcagtcctagctctgttactgaccagataatactaggcaaacagtgtaacctctcccagtcttaacatactcatcgatgaaaatcagaaccgtcatcaccacttcccaggctgccgtgaaaactgaaggaggtaaggtatgtagaagcatcttaattagtacctgacacagaataaataatcaatgtaaatttttgcttccttccttctaagagaaaggaagtagagttctgtggtctacaaactaagtgtggcattggtgcccactaaagagccattcatgaggaaatctgcagatagccactccccactggagggtatggtcttgacttttgcctcagtatctccagctcctacccatcatgggatgtggcacaaagtgggaattcaacaactgtctattggataaataaatggatccatgagtgagtgaaaacatttctctagactagtaaaggatttgagataagttatgtgaaggaaatcaaataggttgtagtaggtgaaacttacctccaagaatctatctgatccccacgcctctgatactgtataataacaagttggtaatgaaagtctacaatactggcagagggggtcatgcataagagcagcattggccttgagaaattcaagcatcccgtaatgcaagagcaggtgggctgagcagatcacttgcttgtaggagttaattgttaaggcaatcaggagttagcaaggaaggcatgagagggattgccctgtaattactattgtttcagcataaattttttttctggcaagtaattgctatgtatctgggttgcagcgataggttctgactgtggagatatctttgaggaatgacttcaatgattaagcacagcctggcatcaccagatggtttgctgtggtccactgcctctggcctcagcagcagcctccagccagacccctgcttccacagttgccccatcacagtccagttcagtagcaattaaaattgacattggatatctaaacaaaatgggaacttacgggaaagatattagaggctcggcattctagaaggagaaactggcatgattaagccaaagaagtaaggaaatgcagggcagagtgggtgaatcatgggggatctaaaggcacgccaagaacatttgcaggaacaggaaacccatccctgtgtttcccaggcacactaggtgggcccctgccttctctcttccgttcctttcagagttgagaaagggcaaacttgtctgaagcagtgtatccatggattaaggaagtaccgtttcctttgccagctctgcctgctgaaagatgaggaggtgacaataacatcttcatcatctacctacaaaggacatgatcaagtctaggccttgcctggaatacggggggataagactaggttagacttgacttggcagtaaagcaggtatcacaaactcacatgccatagggaccagcgagtcagggaataggtgcagccagctgggtgagagacgatacagcatgatgatgtctgtgccaaagtggagatcaaacctacagaaggcctcaaatcctaaacatttttgatatgataatgtggttttacttcccttttattttatttatttatttttttggagacaaggtcttgctctgtcacccagcctggagtacaatggcacaatcacagctcactgcagcctcaaacacccaggctcaagcatccctctgccacagcctcctgagaagctgggaccacaggcatgcgctattacacctggctaatttattttattttattttttgtagaggcgaggtctcccttgcctaggctggtgtcaaactcctgggctcaagtgatcctcccacttagcctcccaaagcgttgggattacaggcgtgacccaccatgcctggcctggttttacttctttaatgtattaacagagtggattcattggtggatttcctaattttgaatcaacctctagcggtgtgctgtagctggctcttaccaggtgacagccaattattaaattttcaggaatttgtttaaagttgttgaggtcatgctggtagcttaaaattggccgtgatgggagtatttacaccatgggaattggcaaatgctataaattggggcggttttcttctttctcagatagctagttgtgaatccagcatgctactgcttgtattcctggaataaactgtgcttgatcttgttgtattatttttgtcattactgtattttacagtaatgtgttactgtaattagtatgtcacattctttgtcagctttatttcttaaaacctttcatatttttgtatggtccagtttaaatctctgattcttaattacctagggagtatcataaaatgcagatgctagtccatgcacctgatcgataatcagaatctgagggtgaaacacaaatactagtactttttaaaaactccatagatgattccaatgtacagccaaggttgagaactagtggcctagtccagtgcttgtcaaacattaatgtgcatacagatcatctagggatcctgttaatatgcaaagtctaatttagcaggtctggggtgagcctgagattctgcatttccaacaagttcgcagcgatgccacggctgctggtccgtagaccacaatttaagtagcaaggatttgaattaacattgtaattatccatgctttaaaggttacataaaattcagctattcagccatttcatcctggtactttcttcaacatccaatcttattacctttccatctcttctgtagaacttagtccatttaaattttccactttttcctctgtcaattttggtattacatgttttgtgagaaatctgtttctcttggttttcaaatatgctgtcagagtgacgctgaataacctcttactattttttaaattatctcacatctgcaattattaagcattcaaattcaaagtttaaaaaatatttgtcaagtgcagtggctcatatctgtaatgccaatactttgggaggctgaggcaggcagattgcttgagcccaggagttggagaccagcctggacaacatggcaaaacctcatctctacaaaacaaatacaaaaaattagccaggtgcagtggcacctgtttgccagtagtcccagtcacttgggaggctgagatgggaggattgcttgagcccagaaggtcaagttgcagtgagccaagatcacaccactgcactccaccctgagtgacagtgagactctgtgtcttaaaaaaaaaaaaaagaagaaatcggctgggcatggtggctcatgcctgtaatcccagcactttggaaggccaaggcaggcggattgcctgaggtcgggagttcgagaccagcctgaccaacatggagaaatcccatctctactaaaaatacaaaattagccaggtgtggtggcgcatgcctgtcatcccagctactcaggaggctgaggcaggataatcgcttgaacccaggagatggaggttgcggtgagctgagatggggacaccagcctggacagcaagagcgaaactccatttcaaaaaaaaaagaaaaagaaattaagtcaaccaaaccaaacatctgtggctgactgtccttcaagcttccagtttgcggtcttgccaaagacccctgtttgctaggactgccataacaaaagaccacagactgagtaggcttaaacaatagacatttattttctactggctcaaggttccagcagtgttcagtttctggtgaagactcccttcctggcttgcagatggccaccttctccctgtttcctcacatggtatttcttctgaatgcacatgcaaggagagagagatctcgtgtctcttccactttttgtttttgtttgagatggagtctcactctgttgcccaggctggagtgcagtggtgcaatctcggctcactgcaacctctgcctcccaggttcaagcgattcctgcctcagcctcccaaatagctgggactacaggtgcccgctaccatgcccaccaccacgactgcctaatttttatatttttagtagagacagggttttgccatatcagccaggctggtttcaaacttctgacttcaagtgatctgctcgccttggcctcccaaagtgctgggattacaggcatgagccaccatgcctggcctcttccactttttatagggacactactactatcagatcagggcccatccttgtgaactctcttcatttaaccttaatcacctctttcaaagccttatttccagatacagccacatggttagggcttcaccatgtaaatttggcggggaggtgcagaggggtgacaaacattcagtcaataagtttcaattactccaattatttcacctattttgagttgttgctgactccagaagattctgttaaactatgtcactgaagagctaatcccagaatagtttcagagctggactatgcttaacaactatgtgattcaatcacagtattttacacatggagaaactgaggcccagagaggcacatcattcacctatgcagagtggaaaggttaagattagaaccagggtgtctgggcatccaatcaggaatagaaggtatgtcatccctttgttactaccacacctcctgcactacaataattcaagcacagtcactggatgtgaacgatgtgcagacgtggtgcttacctggcactcaaggttttctatattcagatcattttgtgatgttcacagcttttctccgtgaccctgggggaaagtgatgctattaaaaaaccaatgattgtaggaagcttctggaacccccactgggctggagggacaaaaaggagagaatagtttttacccagagcccatgagcatgagcttactcacaacgaatgcatctgtagtgttgctgatgctgccactaccacgacaatcactgcctttctcattgggcaggcagccaagagcccacctgttcatgctattgaaacagccaccagagccattggggcccttacttacccagagccacccctgctgccctcgccccagtaccctaccattgcaaggcccacaattgcctactatacctactgataaatgtcataaacagaaaaaaatggcctctccctcccaccttccaaccaacttcacataaatgcctcccactagcagaacctacctggcaaggaacccagctgacaaggaagttcgggaaatgcagtttccaggcttctagcccctgagatataggggagaatgtgggccaggtgtgatgactcacgtctgtaatcttagcactttgggaggccaaggtgggaggatcgccttgagcctaggagtttgagaccagccaggccaacacagtgagaccccatctccaaaaaaaataacagaatgtggaaaggcaggaatagccatagacaatatccgggtatagttattaggaggaagtgaacaggcaagaatgtggtacctgaaggtcaagttttagaattcagacatgtcccaccaacaataatcagcagtgctgggggggtgtcacaaattccatctggaggagccctttttctctggtcttcccaacaaaactagcccagaggagaatctcatctcctgcctcagaggaacagctgaacgaagctgagcaccccctctgggaggtcagaaagtcttctgttcaggcagagaagcctagaaaccagaggctcccattccactctcaggtcaggagctgtattagtcagctggagctgccataacaaaatgccatggcctaggtggctttaacaacagaaatttgttttctcacacttctggaggctggaaatccaagaggaaggcaggtttggcttctcctgaggccctctccatgacctgcacacagtctccttctggctttgtcctcgtttggccttttccctgtgcatgtgcatcccagtgcatcttcctcttttataagaatgccagtcgtggaggattaggactccacccttatgcactcatttaatcttaattacctctttaaagggctcatctccaaatagagtcatgggggatgggaggttaaggcttcaatttatgaacaagggatacaattcagtccataacaggagcccagttgatatctccaactctgagagtaaacagaggccttttttttttttttttttgagagtcttgctgtgttgcctaggctggagtgcaatgacatgatctcggttcactgcaacctctgcctctcggatttaagagattctcctgcctcagcctccggagtagctgggattacaggcacctgccaccaagcctggctaatttttatattttatttttagtagagatggggtttcactgtgttggccagtctgattttgaactcctgacctcaagtgatctgcctgcctcggccccccaaagtgttgggactacaggcgtgagccactgcgcctggtccagagacctgacttttttttttttttcccaagccaaactgtatccagctttattaaagatactttccataaacaatcatggtatttcaggcaggacgtgggcagacaatcgttaacagtatacaacaactttcaaactcccttctgcaatggactaccaaaaatcagaaagccactataaacccaatgaagtcttcatctggtgctctgaacagggaaagtttagagtgagggttgacatttcacatttagcatgttgtttaacaacttttcacaagccgaccctgactttcagtaagtgaaaatggcagaatttatctgaagatccacaatctagaaatggaaccactgctcttttgacaggtgccatctcagtggcatcactggaaagtccagattgcctgacacactggtaaccaacgactaggggtcaggtcccaacagatgtctgggcttaagggagttaagtctatgctgaaagatggaaagggagaagaagaaataaaaacaaatttgtttttccataccacaaggcttttgtgccaaggtggccatgtgtgtcaaagtcagggaatccctcctcctgggagccaagaggaagtctctcaaaactagaagggaaaggtgttttctccacatcgatccagctttggagacattctattagtgacatatgccccttccccccaaaacaatgaagtgttctgtgtgctaacaacatacctttaaaaaaaaaaaagtaaaacaaaattctgcatctttataaaacttgataaaaaatagtatttcaaggccggttgcagtggctcacgcctgtaatcccagcactttgggaggccgagcggagcagatcgcgaggtcaggagatggagaccatcctggctaacacggtgaaaccctgtctctactaaaaatacaaaaaattagccgggcatggtggcgggcgcctgtggtcccagctactccggaggctgaggcaggagaatggcgtgaacccgggaggcggagcttgcagtgagccgagatcgcgccactgcactccagcctgggcgacagagcgagactccgtctcaaaaaaaaaaaaaaaaaaattgtatttcaaactgtacagtcaccagaagtacacagctatcaaaaatgcacacacttcacttggcatctccagcaccttcagctttctgtgactggtctgttttggcatctccattttctgcagggttattcccctccttgccagcatcagcctttccctttttccctttgggtaccttctctcccttctttgcagaggcctttttaggcttgggctctggctttggaggagcaggtttagcagacaacctagcggatcttctctgcggttcgtccttcaccttggctttatctcctttagcatctccttcagcctttctcttgggcatggtggccgcggcgatggcgacggcggcgggacgtaggtgctggacgcgggacacagcggcgcacgggctttggtcggtccgggggtcgttctcacctcttcttcatactgctccgatatctgactttttaaagccctggtcaggaatatgctgagtcacccctgactcccacctctagttgtaacttacattggtttgttcttccatttacttatatcacaagtatttattgagttccaattatgtgcccggcactatatcagtactggggacatggatgttgacattggacaggtgactgcagtgccatatgacagaggcatgctcacagcgcttatggtcaggctgttggtgggatgccctgcaagcaaagacaccagacaaggctttctagaggacatgcgatgggaacccagttctgaaatacaaggcagaattatctggttggggagtggatttgtttaatcagtgggtccctatttgcctagacttgtacaggagaggaaggtagagtttatataaaacttttctactccaggtgtggcccacagatcaggagtactggaatcagctgggagcttctcagatagactcactctcagagtccatcccaggcttactgaatcaaaagctacagtttaacaagctccccagggcacaggtgaacattaaaatttgggaaacactgatgcggtgcaatcccattgcttcacagatggacaaaccaagacccagagaacaagtgattcttttaagataatacagataacacagcattaacaggaaagaaagaaaagtcttaaatctaaattcaacactccccttcagtccgatggattgacacatttcccagtccacctacaactttcacatcacattatgatgccagatctttctaccaacaagccctttggctatgcctagaggactcattattagctctcactgatcaggtgagaacatgggggccccaaaaacggacctctattgacactgtttctgatttgggagcgtttgggctgctttgtgggtgtcttttatattcttcatttatttacttaaatggcagacattgctaattgtttgggtcagggaatatcaagccttgagcctggtttaaggtgctttgagacccttacacccctagacacctcacagaagcaaatgtagagactttctgaaggaaagggccttcaacataggcctcatatcatttctacacatagtttttcaaatgcagtgtccaggctgggcacagtggctcacgcctataatcccagcactttggtaggctgaagtggatcacctgaggtcaggagtttgagaccagcctggccaacatggtgaaaccccatctctactaaaaatacaaaaaattagccaggtgtggtggtgggcgtctgtagttccagctactcaggaggctgaggtgggagaatagcttgaacccaggaggcagagtttgcagtgagctgagatcatgccattgcactctagtctgggtgacaaaaggagactttcaaacaaaacaaaacaaaaaaacccaaaagcagtgtccagcacacagtcgtagataactcatagagtacaagactggcaattggcaggaaaaaaagacaaataatagaaacagatctgcaaagagttcaaatattgaattatcagatgtagactttttaaacaaatagctgaatttattttatttcattttatttttctttttagattaggattaaccttgtggagcagagataactcataggcagtacacacacagtcagcctgaattttttttaaggcaaacttgttgatatattcaatgaattggaaactacgaaaatcaatgtagtcaatttttttttttttttttttttatctgagacagagtctcgctctgtcactctggctggaatgcagtggcgcgatcttggctcactgcaacctctgcctctcgagttcaagtgattctcctgcctcagcctgctgagtatctgggattacaggcacatgccaccatgcctggctaatttttgtatttttagtagagacagggtttcaccatattggtcaggctggtctcaaactcctgacctcgtaatctgcccgcctcagcatcccaaagtgctgggattacaggcgtgagccaccgcaccagcctatgtagtctatttttaaaagaaccaaatagaacttctagggaaaaatgtaataacaaacatatatgcatgtgtaaatatatatataaatgcctacatgctaagttcagcagataggtttaatgacaaaaactataaaactgaagagggaagtagggaattgggagacaggactggagaacgtgattctgctgctggacggcgagccccacaattggggcttagccctgaagagttctcagcttcatccaggaaagaattcaaggacaagcctgtggtgttaaatagcaatcttatttgaatagcacctctccctacagagcaggggtaactcacaggcaatgaacccagagtctgcaacgtatgggctgttggcaactctatctacttgtacccactttcaattacttgtatattaaggggcaagctgatgcaaattgagggccaagttatttagaaagatctagtaagttactactcctttccatggcaatgacccacaaaatttgtcgtcatggaaagaggcagtaacttccgggtcgttgccatggcatttgtaaactgtcatggcgctggcgggcgtgtcctatgctaatgagcaatgagggcggctagggattgcttttgtcgccatctgctggtttccaccggtttcttcacttcatcctgtgtggaccatcttttggtcagcaggactgtgaccagaagacaagtcctgccagtctcctacctcatttccaagagacaaaaagataggatgtgcagcggaatagaaaaaagacttagaaaacatattttaaacatctaatgaacatgttgtcagacacccagaaggaggagtgagagaatgggcagtgacaaaattgaagatggagtggctggaaagaggaccttcacagcaccacccacgagtaaggggctgctgtaaagagacagaggtggtcgccatgctcctgcagcccagtgggttcctttttggaatcagagaatcaaaataaaagggccgaattccacctccagtctcattcttggcttcgatatttcccctccagatgtctttttatgtctttttcatctatttccagtaggtccttattctgtgtgaaaaaattaaaaatccggtgtttattttggatttcacagacacagcaggcacagtccctagacaaaaatacataactcagtgctcaagaaagagttttgtgtttcctggtgctgtgcatgttagaggcacctgggacagggagcagatctctctggagtctgagtggcaggtctgctgcctgcaaatgtgtggtctgtgcaccatacgaaggtgcctgctaagaggacagggtcctgaattccagccgtggctctgcttgacaagctgtgtgctccagctagggcctaacagaaggctgccttctaccaaaggtgttacaccaagctatgaggcctgcatttgcccagagcaggccctttttctgttttgcacaaaagcactcattgattaatggtgttccacccaactgtccactggagaagtatctaacaagagacaaatccattctcaggtacttcgcaaaggccaaccaaggctatgtaatggtgtgtgtggggtacagcatggttgtagggtggccaactgtgggaaccccacactgaggagttccctgccatgtgtggctgctatgctaaagtcaagacagtgtcagcaaacccagatggttggtcatcttactcttggagctccctcaagtttgggcagcttttgactgtcactacagaaaggactgaattattggtgttgccctttcccttcccctgttgttcccttgccttgtgctgacacttacgtttgtagggcacagaccatgtcgcagcaggaggaattctccccatacaaacttctatctctgaccttctggttgttatacagaaaagtactcatattttatggccaggtgtggcagctcatgcttttaatcccagcactttgggaggctgaggcaggtggctcacttgaagccaagagttcttttttttttttttttttttttgagacagtctcattctgtcacccagtggagtacagtggcacaatcttggctcactgcaacctccacctcctggtcaagtgattctcctgcctcagcctcccaagtagctgggactagagggatgggccaccatgcctggctaatttttgtatttttagtagagacggggttttgacatgttggtctggaactcctgaactcaggtgatcaacctgcatcggcctcccaaagtgctgggattacaggcggaagccaccatgcccaaccagcctgggcaacataatgagaccccatcttacaaaaagtagtaaaaattagctggtgtgtgcttgtagccctagctactcaggagactgaggtgggacaatttcttgagcccagcagtcaaggctgcagtgtgctatgattgcaccactgaaatccagcctgagtgctagagcaagaccctgtctctgtaacaacaacaacaaaaaactaaatgaaaatattttaggccaggcgcggtggctcacccatgtaatcccagcactttgggaggccgagggggagtggatcacgtgagatcaggagttcaagacctcgccagtatggtgagatccccgtctctactaaaaatacaaaaattagctgggcgtggcgatgcgtgcctgtagtcccagctactcgggaggctgaggcaggagaatcgcttgaacccggcggggcagaggttgcaatgagccgagatcacgccaccgcattccagcctgggggacacagtgagactctgtcttggaaaaaaaaaaaagaaaatattttatggtactgaatttcttgccagtgtatttttctgtacatatttttatatagttcagaacagattgtataattttatatctagcttttttaaacttaacattataatgtgaacattctattaaaatgttgaaaactttttttcttagacacaatgttcattgactatattctgttccatcatatggctatatcttagcttgacccccctaccagtcatctagactggggcaacaaacttttccttaaaggtccagatagccaggcgcggtggctcacacctgtaatcccagcactttgggagaccgacgcaggatgatcactttgagtccaggagtttgagacgagcctgggcaacatagcaacaccccgtttctctaaaaaaaaaaaaaaaaaaaaagaaaacaaaaacaagatccagatagtaaatattttaggctttattggccagatagtctctgcccttgtagcatgaaaggagccataagccataaacaatacatatacgggtgtggctgtatttaacacaactttaccagaataaaaggaggactagatgattctctgggtcatgtaacagagtccaaagagtgtactactcactgcatgacatttaataagtcaagagacaaggggttgaggcaaggaaagtgacttttattcagagagccagcaaaccaagaaaatggaagagtagtgtcctgaagaaccatttttaagtcaatacaaatttcaggctccttttacgtgagaggaagggggaagagggagggagttgaggtcaagaagtggccagtgatcacatctgggtggtggcaagggtccaaggaggtggtgaaactttgtccttggtcaggtcacagtgctcttataaatctttaacataacattattacttgcatacatcctccttatctcctcaggggttagttttgggggaggcactattaccatccttgctctaaactataaactaaattccttctatagttagcttggcctatgtgcagagataagcaaaagcagttaacctaaaagatacaggttatcgctgcaggggggttaggagcaaaatggagttagtcacgctaggcctccttgtcactgttatagccatagcttgtggatctctggtttagactatttataatgtttggtactataaataatgcagctaatgaatatctttgtgaagaagtccttgaatatgtcagattatctcttaggaaacaatcctacaaattgagttactagaacaaaaaaaaagtatggctatttttaaggtccttgatccataatatgggatacaagtcgaagtagctttctgaatagccacctaaccttaactcagcatcattcttggaccctgcccatgtccctgggaatccctggaactaacatttctttggttcttttttttttttttttaagagtcggggtctcactctgctgcccaggctggagaacagtggcacaatcatggctcactgcaaccttgaattcctggcctcaaattatactccctctcaccctcccgaagtgctgggattataggcatgagcatctgtgcccggccacttttcattagtcctaagcacacaccaccaagttcagttttcctgagatgcctccattctccagatcattcagcccctttacagtggacaattatgcttatctatttctgcttaaatcatctatctatgtgctaccttttccttcccaacccaattgtttaaagatgacagactagaccaggcaccatggctcatgcctgtaatcccagcactttgggaggcagaggcaggaggatctcgaacccaggagtttgagaccagcctgggcaatataaggagactctgtctttacaaaaataaaattagccacacatgctggcacacaccttcagtcccagctacttggaggctgaggtaggaggattgcttgggcctgggaggcagaggttgcaatgagtcatgatcaggccactgcactccagcctggcaacagagggagacttgcttcaaaaaaaaaaaaaaaaaaaagacagactaagcatgtgtacctagttaggatccttctggaaaccccacgaaaatgacagcaaaaggatatttttatcacataaaccccatacaactgattaaatttgggagaacattagaaacaaggacattctatcatttgcaacaacatgggtgaacctggaagatattatgctaagtgaaataagccagattcagaaagacaaataccacatgatttcacttatacgtggaattttaaaaagttgaactcacagcagcagaaagtagaatggtggttaccagaggctgggggaggagaggagtaggggagatgttgaccaaagggcacacatttcagttagccagggggaatacgtttttgagatctactgtacatggtgaccatagtcaataataatgtatactttgaaggagcatctggaattttacccccagatatggctccctggtataatgagtattttgaattaaatgtccttagcaatcaacagatgctagaagaaaccttttccctatctacataaagacctaagggatccaccaaggaaaacaattactaagtttttattccatttctcctattaatctgcatttggtgagtgattttttagttattcttcagagggcaaaggggaagtttgttcctggcccctacagtttcaaaattgtaaaaataataacaataatgaattttttaaattacacatttatttttacttttttttttttttattagagacagggtattgctatgttgcccaggctggtgtctggaacccctgaattcctgggctcaagcaatcttcctgccttggcctctcaaagtgttggaattacaggtgtgagccaccatgcttggccaagaatagattttacatgttctcaatacaaagaaaaagaagtatgtgaggagtgtgatatgctaattagcttcatataatcattccacaatgtatacatctattactatcaaaacatcatatttatcccatatatatattatttgtcaattaaaaatgtaaattttcatttaaaattttgaagggctagaaaacaggataaatagcaactgacttagcaggcttgtgaagctgagtcttaagccagcagggatgaaagtcaagaagcaactcaacttgcattgagactcccatagagttttgtgaccaggctttggtagtaccagctacgtctagtataagtgggggtgtgtataagactgaatacaggagaattggttggaagtcagtaagaagaagttagaaccctaaatctctcctgcaagtccacacagccagactgtacatcccccaccccagaataagactgtaagttgaaaacaaaaggtctctggataaagggttaccaggcaaaattagggttgaggtactatactgaaaacaatatcatactggaagattattttctgtggttcatataatacaaaagcacagccagatatcctacaaagaatcccaggttccagacttttgtttgagacctgaaaaagaaacaaaaaagagataaaagaaaacaaaataagtaaaaaccaataaataaaatgaagcccatgttgacaactccacctcatgtgctcagagcttccaagcagcttttaagctccgcattaaaaaaaaatatgaatggaaaaccaagggtcaccacacatctgagaaaagctcctaataaagatagagaccaaaacaggaaataaagaaaaaaatagagaaaacgagactatgcagagagaaattaaatattaatggacaagaagttgggtgcagttgctcacacctgtaatttcagcactttggggggccgaggcaggaggatcgctttaggccaggagttcaggaccagcctgggcaacatagcgagaccatctctctgtaagaaaaaaaaattagttgggtgtgatggcacacacctgtagcctcagctactcgggagactgaggtaggaggatcacttgagcccaggagttccaggctgaggtgagctgtgatcacgccactgcactccagcccaggcaaagacacttcaactctagaagaatgaatatgattttgttggatagggttgagtttttgaaggccacagatcactgttatataaaacattctcttgtcaatccccaaagaaccaatttttgcccccttgggggacaattactgcccctcttagagaccccttctctactgaaatgcatgctttagagaaataacacattgcatctgtgaaataatgggttactatttttaaaatgaacactgaagtgagaaagagaagtagctcagagaagtctgaaaaatgtgtggtatgcaaaatttatcaggtccagagagacacaatcttcagagaatgaatcttcagtcacacccacccctccccagagaatcatgcctaggaacaattgtttaaaggcattttgttctttctttccttccatgtagtttccagactggctgataaattacccaaaatgctatcacaagttgcacaatatgaccctcacccattatcttcatgttcctggaatttgtgatacaaagaacaacatatgccaattagtagcttatgttcaatttaggaactgccccttcttttttcctttaaaaacccacttgttggccaggcgcagtggctcacacctgtaatctcagcgctttgggaggccgaggtgggcggatcatctgaggtcaggagtttgagaccagcctggccaacatggggaaaacctgtctctactaaaaatacaaaacatagctgcgcgtggtggtgcacgcctgtaattccagctactagggaggctgaggcaggagaattgcttgaactcgggaggcagaggttgcagtgagccaagattgtgccactgcactccagcctgggtgacagagcaagattccatctaaaacaaacaaacgaacgaacaaaaaaaccccacttgttgactgcttgaagccaagagttcaagaccagcctggtcaacataacaagaccctgtctccaaaaaaacaaaaacaaaaaccaaaaaatccacttgtaagtgctgctaatcacagcatatattcagggcaacttaacttgaatctgtgtctcctgggctgtagccctcaaatttggcccaaataaactctctgcttacattaattttgcctcagtttattcctgtaggtgaaccaataaaaaagagctcttagaattgtagtgttaccagaaagggatcccaatccagaccccaggagagggttcttggaccttgcacgagaaaagaatttgggacaagtctgcaaagtgaaagcaagtttattagagaagaaaagaaacaaaagaatggctcctccataggcagagcagaggcatgggctgctctatgagtaaacttatggttatttcttgcttatatgctacatatggggtggattattcatgagttttctggcaaagggtgggcaatttccagaactgagggttcctcccctttttagaatatgtagggtaacttccaggcactgccatggcatttgtaaattgtcatggtgctggtgggagtgtcttttagcatgctaatgcattatagctagcatataattgttaccagcagcaaagccacatggggctgcagcaactagatgcctgcttccttggaggacagaattcagccaaggggcagaagcaggtttaaggcagagggagagattgagacaacttttagagcaggaatgagagtttattaaaaagttttagagcaggaatgaaaggaagcaaagtccacttggaagagggccaagtgggtgacttgagagatccaagtgcccttttcagcccttgacttgaggttttatacatgggcatggttccagggtttctgcttctcttcccttaattgtccccttggggtgggctgtgtgtatgtgcagtatgtttactgaagttgtacacatgctaagttgaggtgtgtttccattaccagtcaagtgttcccagaggaaggtcatacacccattaaactctgctgttttgcctcttagtgaacgtgccttagtccacttgcccaactccaaagatcttaccaggaagctgctgattaccagttttcggtgtttccttttctttttttttttgagacagagtttcactcttgtcactcaggctggagtacaatggtgcaatctcagctcactgaaacctctgcctcccaggttcaagcgattctccagccttgcctcctgagtagctgggattacaggcatgcaccactacgcccggctaattttgtatttttagcagagatggggggtggttctcaccatgttgcccaggctggtcttgaactcctgacctcaggtgatccacctgcctcagcctcccaaagtgctgggattacaagcatgagccatggtgcccagttagtttcaggtgttttctatctattgggagattgtctttctctggcactggctacaaccaattgttattttagagagacagtttaacaactgcctgaccatcatctgatgatcacctgacattcctggagacagggccctcccctgccctgctcatgtctgcctaactaccgattctaacataatgaacagtgaggatgaccagaggtcactttcattaccatcttggatttggcaggttttggccagcttctttactgtatcctgttttatcagtaaggtctttgtgacctgtatcttgtgccaacctcctatctcatcctgtgactaagaatgcctaactgcctgggaatgcagcccagtaggtctcagctttattttacccagctcctattcactttggttcaaatgcctctgacagtaggggccaagggaaaaacttcccctttgtcctctgaaggtttactgaaaaatcaactcacaaaatgcagattagtaggaaaaaggcatcaaaacttattaatgtgtacacaggggagaatcagagtgatcactcaatatcccagtggggcccaaatacttatatagccttatttgagaggggagtgaggagatggggaatataggtaattctgttgaggtacaataaacgattgctagggagaatgaatggatcagggaacagagattagcttgtaaatcgttctctttgaaaaaaagattttttttttttttgagacaggatcttgctctgtcccaaaggctggagtgcaatggtgtggtcacagctcactgcagccttgacctactgggctcatgtgatcctcttgtaaccacccatgggttcaccttgcctgctgcctagacagagccaatttatcaagacaggggaactgcagtagacaaagagtaattcacacagaccagctgtgcgggagaccagagttttatgattactcaaaaaagtctccctcagtatttggaaataagagttttgttgttgttgttgttgttgttgttgttgttgtttttgagatggagtttcgctcttgtcgcccaggctggagtgcaatggcgcaatctccactcactgcaacctccgcctcctgggttcaagtgattctcctgcctcagcctactgagtagctgggattacaggcacatgccaccatgcccagcaaatttttgtatttttagcagagacgggattttgccatgttgtccaggctggtctcaaactcctggcctcaagtgattcgcccgcctcggcctcccaaagtgctgggattacaagtgtgagccactgcacctggccaggaaatgagagtttttaaggacaacttggtgagtaggggaaagccagtgaaccaggagtgctgattgatcaggtcagagataaaatcataagaagctgaagctgtcttcttgcactaagtcagttcctgggtgggagccacaagatcagatgagccagtttatccatctgggtggtgccagttgatccatcaagtgcagggtctgcagaacatctgagcactgatcttaggagcagtttaaggaggcccaaaatcttgtagcatccagctgtatgactcctaaaccataatttctaatcttgtggctagtttcttagtcctacaaaggctgtctagtccccaggcaagaagggcgtttgttttgggaaagggctgttgccatctttgttttaaactataaactaagttttaaattataaactacttttctcccaaagttagttcagcctacactcaggaatgaacaaatacagctcggaggttagaaggaagatagagttggttcagtcagatctctttcactgtctcagttataattttgcagtggtggtttcactcctgcctcagcctcctaagtagctgtgactataggcatatgccaccatgcccagctaattttttttttatagagatggagtctcacggtgttgcccaggcttgtctcaaactcttgggctcaaacaatccttcctgctcagcctcccaaagtgctgggattacacgcatgaggcaccacacctggccttttttttttttctaagttttttgttgtaggttgtgctacatttcccaggctggtctcgaactcctgccctcaagcaatcctcccactttggctccccaaagtgctctttggaaattgagcctgagagaagaatattatcttgtgaataagtctgtttaggtgtggttaattccttgctcttcttttctgcaatagatgagaaagcatgaagcagaaggaaaaacgatcgttttccttggtgggtccttcagccctttatgtagatagagaaaaagtctcttctagcatctattgatctttaaggacctttaattcaaaatactcattataccagggagccatatattggggtgaggttgccttgcctgtactcctccagaatttattttttaattttaatttttttttttgagacggaatttcactcttattgtccaggctggagcgcaatggcgcaatctcggctcaccacaacctccacctcctgggttcaagagattctcctgcctcagtctcctgagtagctgggattacaggcatgcgccaccacgcccggctaattttgtatttttagtagagatggggtttctccatgttggtcaggctggtctcaaactcccgacctcagtggtccacccacctcggcctcccaaagtgctgggattacaggcatacgccaccgcgcccggccaatttttttttttttttttttttaaagagaaagaatcttactctgtcacccaggctagagagcagtgaaattatagctcagtgcatccctgaactcttgggctcaagggatcctcccaagggaggcacagtactgccttactgggtgacacagtaagactccatctcaagggaaaaaaaaaagattgtaagttaaatctcctagaaagccaaacacttgtcagatagtgaaaaaagaagagaacagattgtaaatttatagcatcagttcagtagtttcaacattttaataaggaggctaggggacacaatgggtcacgcctgtaatcccagcacttcaggaggccgaggtgggtggatcacttgaggccaggagtttgagaccagcctcgccaacatggtgaaaccccatctctactaaaaatacaaaagttagctgggtgtgttggtacgcacctgtagtcccagctacttgaaaggctgaggcaggagaatcgcttgaacctgggaagcagaggttgcagtgagccaagatcatgccactgcactccagcctgggtgacagagcaagactctgtctcaaaaaagaataataataataatgaaaccacctttgcaaaaattgtaacagaaaattatgagacaggataattcccttgacctccttgcagtacttgcaactggggtgtggcttgtttactcggccacctcgtgctcaaaccccttgtgagagtgagtgagtgcaggaactggaaaaaacgaatgctggaattggccagttgctcctctctggcaggagcaggctcggtgcaggccccataacagcatccaaacatgttgaaaccaatgctgtttcagctcttcagtccgaggacagctaagtgccaaccagctcagtggagggtcagggtggcagcccctgccctctcaacacccaggttcttgtccagcatccaggaagaatcatgtcacacgaacagattgaagggtagtgtatgcagaggattttactgggcgatgaaagtggctctcagcggctctcagcatccaggaagaatcaagtcacatgaacagattgaagggtagtgtatgcagaggattttactgggcgatcaaagtggctctcagcgggatggggagttgaaaaggggatgatgcgggaagaaggtgatctttccctgaagccgagcagtctgagggcaggcccctctccaaagccgcatcatctgaagttagccacatctacccatagtctccaacattcagttgcttctctgcttactgctcagccacttgtatccttgacaatcagccgtttgtatccccaatgctcagctgctgtgttgctctgccagctgaaatctttttatgagcacaggatggggaaatggcaggccaaaaaggcaacacgtgggtggaaaaatggggctcctgttttcacttagagctgaggttccaggcttaagggtggggtttacccaggagcccagcccttctgtatcaatggcagcgggggagatgtgatctagccaatctccatcttgcttttagccttctttttttttaatcctccatgcacatttttgtgctccactctactaaaatgttacattgcagaacaattccagatcctgtaacttaggtcctgtatgttgacagtatttatttttattatactttaagttttagggaacaaaacgtgcaggtttattacatatatatacatgcgccatgttggtgtgtcgcacccaataactcgtcatttaacattaggtatatctcctaatgctatccctcccccctccccccaccccacaataggccccggtgtgtgatgttccccttcctgtgtccatgtgttctcactgttcaattcccacctatgagtgagaacatgcggtgtttggttttttgtccttgtgatagtttgctgagaatgatggtttccagcttcatctatgtccctacaaaggacatgaactcaccattttttatggctgcatagtattccatagtgtatatgcaccacattttcttaatccagtctatcattgttggacatttgggttggttccaagtctttgctattgtgaatagtgctgcaataaacatacatgtgcatgtgtctttatagcagcatgatttataatcctttgggtatatacccagtaatgggatggctgggtcagatggtatttctagttctagatctctgaggaatcaccacactgacttccacaatggttgaactagtttacagtcccaccaacagtgtaaaagtgatcctatttctccacatcctctccagcatatgttgtttcccgactttttaatgaccgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccacttgttgatggggttgttttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagattaattagatcccatttgtcaattttggctttcgttgccattccttttggtgttttagacatgaagtccttgcccgtgcctatgtcctgaatggtattgcctaggtttccttctagggtttttatggttttaggtctaacatttaaatctttaatccatcttgaattaattttagtataaggaataaggaagggatccagtttcagctttctacatatggctagccagttttcccagcaccatttattaaatagggaatccttatcccatttcttgtttttgtcaggtttgtcaaagatcagatagttgtagatatgtggcattatttctgagggctctgttctgttccattggtctatatctctgttttggtaccagtaccatgctgttttgcttactgtagccttgtagtatagtttgaagtcaggtagcgtgatgcctccagctttgttcttttggcttaggattgacttggcaatgcgggctcttttttagttccatatgaactttaaagtatttttttccaattctgtgaagaaagtcattggtagcttgagagggatggcattgaatctataaattaccttgggcagtatggccattttcacgatattgattcttcctacccatgaacatggaatgttcttccatttgtttgtatcctcttctattacattgagcagtggttgtagttctccttgaagaggtccttcacgtcccttgtaagttggattcctaggtatttcattctctttgaagcaattgtgaatgggagttcactcatgatttggctctctgtttgtctgttattggtgtataagaatgcttgtgatttttgcacatcgattttgtatcctgagactttgctgaagttgcttatgagcttaaggagattttgagctgagatgatggggttttctagatatacaatcatgtcatctgcagacagcgacaatttgacttcctcttttcatgattgaataccctttatttctttctcctgcctgatttccctggccagaacttccaacactatgttgaataggagtggtgagagagggcatccctgtcttgtgccacttttcaaagggaatgcttccagtttttgctcattcagtatgatattggctgtgggtttgtcataaatagctcttattattttgagatacgtcccatcagtacctaatttattgagagtttttagcatgaagggctgctgaattttgtcaaaggccttttctgcatctattgagataatcatgtggtttttgtcattggttctgtttatatgctggattacatttattgatttgcatatgttgaaccagccttgcatcccagggatgaagcccacttgatcatggtggataagctttttgatatgctgctggattcagtttcccagtattttattgaggatttttgcatcgatgttcatcagggatattggtctaaaattctcttcttttgttgtgtctctgccaggctttggtatcaggatgatgctggcctcataaaatgagttagggaggattccctctttttctattgattggaatagtttcagaaggaatggtaccagctcctccttgaacctctggtagaattcggctgtgaatccatctggtcctggactttttttggttggtaagctattaattattgcctcaatttcagatcctgttattggtctattcagagattcaacttcttcctggtttagtcttgggagagtgtatgtgtcaaggaatttatccatttcttccagattttctagtttatttgcatagaggtgtttatagtattctctgatggtagtttgtatttctgtgggatcagtggtgatatcccctttatcattttttattgcatctatttgattcttctctcttttctactttattagtcttgctagcggtctatcaattttgttgatcttttcaaaaaaccagctcctggattcattgattttttgaagggttttttgtgtctctatttccttcagttctgctctgatcttagttatttcttgtcttctgctagcttttgaatatgtttgctcttgcttctctagttcttttaattgtgacgttagggtgtcaattttagatctttcctgctttctcttgtgggcatttagtgctataaatttccctgtacacactgctttgaatgtgtcccagagattctggtatgttgtgtctttgttctcgttggtttcaaagaacatctttatttctgccttcatttcgttatgtacccagtagtcattcaggagcaagttgttcagtttccatgtagttgagtggttttgagagtgagtttcttaatcctgagttctagtttgattgcactgtggtctgagagacagtttgttataatttctattcttctacatttgctgaggagtgctttacttccaactatgtggtcaattttggaataggtgtggtgtggtgctgaaaagaatgtatattctgttgatttggggtggagagttctgtagatgtctattaggtccacttggtgcagagctgagttcaagtcctggatatccttgttaactttctgtctcgttgatctgtctaatgtgacagtggggtgttaaagtctccccttattattgtgtgggagtctaagtctctttgtaggtctctaaggacttgctttatgcatctgggtgctcctgtattgggtgcatatatatttaggatagttagctcttcttgctgaattgatccctttaccattatgtaatggccttctttgtctcttttgatctttgttggtttaaagtttgttttatcagagactaggattgcaacccctgcctttttttgttttccattttcttggtagatcttcctccatccctttactttgagcctatgtgcatctttgcatgtgagatgggtttcctgaatacagcagactgatgggtcttgactctttatccaatttgccactctgggtcttttaattggaacatttagtccatttacatttaaggttaatatggttatgtgtgaatttgatcctgtcattatgatgttagctggttattttgcttgttagttgatgaagtttcttcctagtctcgatggtctttacaatttggcatgtttttgcagtggctggtaccggttgttcctttccatgtttagtgcttccttcaggagttcttttagggcaggcctggtggtgacaaaatctctcagcatttgcttgtctgtattttatttctccttcacttatgaagtttagtttggctggatatgaaattctgggttgaaaattcttttctttaagaatgttgaatattggcccccactctcttctggcttgtagagtttctgctgagagatcagctgttagtctgatgggcttccctttgtgagtaatccgatctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattggggaagttctcctggataatatcctgcagagtgttttccaacttggttccattctccccgtcacttgcaggtacaccaatcaaacgtagatttggtcttttcccagagtcccatatttcttagaggctttgttcatttctttttcttcttttttctctaaacttctcatttcatttcattcatttgatcttccatcactgataccctttcttccagttgattgaatcggctactgaggcttgtgcatttgtcacgtagttcttgtgccatggttttcagctccatcaggtcatttaagggcttctctacgctggttattctagttagccattcgtctaatcttttttcaaggtttttaacttctttgccatgggttcgaacttcctcctttagctcagagtagtttgattgtctgaagccttcttctctcaactcatcaaagtcattctccgtccagctttgttccattgctggtgaggagctgcgttcctttggaggaggagaggcgctctgatttttagaattttcagtttttctgctctgttttttccccatctttgtggttttatctacctttggtctttgatgatggtgatgtacagatggggttttggtgtggatgtcctttctgtttcttttccttctaacagtcaggaccctcagctacaggtctgttggagtttgccggaggtccattccagaccctgtttgcctgggtatcagcagcagaggctgcagaacagtggatattggtgaacagaaaatgttgctacttgatcattcctctgggagttttgtctcagagaagtacctggccatgtgaggtgtcagtctgcccctaattggggtgcctcccagttaggctactcaggggtcagggacccacttgaggaggcagtctgtccgttctcagatctccagctgcgtgctggaagaaccactactctcttcaaagctgtcagacagggacatttaagtctgcagaggtttctgctgccttttgtttggctatgcccgcccccagaagtggagtctacagaggcaggcaggcctccttgagctgtggtgggctccacccagtttgagcttcccaaccgctttgtttacctactcaagcctcagcaatggcgggcgcccctcccccagcctcactgctgccttgcagttcgatctcagactgctgtgctagcaatgagcgaggctccgtgggcgtaggaccctccgagccaggcacgggatataatctcctggtgtgccgtttgctaagactgtcggaaaagcgcagtagtagggtgggagtgacccgattttccaggtgtcgtccgtcacccctttccttggctaggaaagggaattcccctgaccccttgtgcttccccggggaggcgatgcctcaccctgcttcggctcgggctcaatgcacggcacacactgtcctgcacccactgtctgacaatccccagtgagatgcacccggtacctcagttggaaatgcagaaatcattcgtcttctgtgtcgctcacgctgggagctgtagactggagctgttcctattcggccatcttcacttttagccttcaagctgccaagctaactttaggagacatttagtttatagtttaaattataatagcccttcccccaaactcaatcacctttgtaaagctaattagagaccactgggctagggggcagagaggagcctgaattctgctaaggtgtaaacataaacgattgccagccataattctggaggtcataagatatgcaacttccccaattattccttcagataacatcactactgtagaacctaagattgaccttttgggatactttctcaggtttcttgcatgtctgacacccatgctttacctggacctactgatcaacagctcctgtggcctcacccaggagtgattcagcatgcaagaagatcatttcccacatccctatgattgcaccccaaccaatcggcagcaagcacccactgtctagccacccccaccctttcccccaaactacctttgaaaaactcctaacctttaagcctttgatgagactgatttgagtgataactccatctcccacatggcatggctggcctggcgtcagttgaactctccactgcaatgctgagattttttttttttttgagacagagtcttgctctgttgcgcaggctggagtgcagtggagtgatcttggctcactgcaatctttgcctcctgggttcaagtgattctcctgcctcagcctcccaagtagctgggattacaggcgcacaccaccacactgggctaatttttgtttatttagtagagacagggtttcaccatgttggccaggctggcctcgagctcgtgacctcaagtgatctgcctgtctcagcctcccaaagtgctgggattacaggcatgagccactgcagctggcccaatgctgagaattgattttcttcgttcagtgggcaggaagaacctgtcaggcagttacaataagagttccaggccagccaccatggctcacacctgtaatcccaacactttgaaaggccaaggtgggctgatcacttgagcccagaagttgcagaccagcctgggcaacatggtgaaaccacatctctattaaaaagtacaaaaaattagccaggcatggtcccatgtacctgtagtcctagctactcaggaggctgaggtgggaggatcatctgagcctgggaagttgaggctgcagggagccatgatcatgtcagaggtgtttgaaccacagcgactccatcttgaataggcgctgggtaaaataaggccaagacctactgggctgcattcccaggaggttaggtattctaagtcacaggatgagataggtcagcacaatgtacaggtcacaaagaccttgctgataaaaggatgtggtaaagaagctggccaaaacccaccaaaaccaagaaggtgaggaaagtgacctctggtggtcctactgcgcattacatgataattaaatatattagcatgcaaaaagacatgcccaccagtgccatgacagtttacaaatgccatggcaatgttaggaagttaccctatatggtctaaaagggggaggaaccctcagttccaggaattgcctatcctttccttcccctgcccccccaacccctcgcccccaaaaaactcatgaataatccaccccttgtttagcatatactcaagaaataactataaaaatagccaactagcagccctcagggccactatgcctacagagtagccattcttttattcctttactttcttagcttgctttccctttactcaaattctttctttacctgaattctttcttactcaaggtccaagaatcctcttggggtctggattgggatccctttccggtaacaattgtgccactgcactccagcctgggtgacgggagtgagatggtgtctcacagaaagaaaaagagagagagagagttccaggagaaattgtgtgtgtgtgtgtgtgtgtgtgtgtgtgtgtgtgttggaggctggggcggggggcggttggggggtagtcctagaagtgttagatgttagggaatcattaaataaatagttcaagtaagtaaatttccccaaactaaagaataaacatttccaaaatcatagcagccatggagagtgcagcccaaaaggtgaaaatatccccatccaaggtacctcaccatgacattcagggaccaggggactggaatgttggggctcagaacaccaccccaaaatatgactgtggaagacgagaattaatgtcacctcaaaatatactttggcatattttgagatggctattccaagaaactaaagacacaggaatagctctgaaaagatctccttttgtgaaagaaatttatgaaagaattttgtaaaaggaaatctacattagcaaacagcagatgcaagcagaggctttctctgagccccccttatctgcctagagatggaactaggaaaaatcatatcacaggaagaggagattgtgggtcgacacgtcccagatagagattaccacaggcggccacccttctgaagggtgctacctgagagattttatctgcataaggcaacctttgtgggctgtgcatttcctcccctctcccttctagaatttgtgccgtgacctcctctccgcacccccaccaagtgcagcaccagatgtaccctctccacaccctctctgcacccccaccaagccccaggtcccctattcctttccatggcctcaagatggtacacacactggctcttctgggagtttcatattttgtgaggcctccatgcatatgtgcacataataaatttgtgtgtctttcctcttgttaatctgtctactgtcaagtttattccagagacaaattattgaactttcagagggtgaacgaaaagttcccctttcccctacagaaaaaagaaaatatccttaaagaacccattctcttatttctggaaggtatcatttagctcatggtgggtaggaatctcacaggttgaaatagcatttctagtagaattgtcacaaggattttagtacacttaagaagttcataaagaagttctaacgatgctagactacctttttttggtaatgtaaaagtaataaagggtcattacagaaaacatgaatttcagaaaagtataaagaagaaaagcaacagctataattgaacaaccctgaaataaatactgtaactgttttggattgcttccttcttgtgcgtgaagttttttcccccatatagcatctccatatcctttaataatatttatcattaaacataactgaaactatacttgtgaacagttttggagtgatggagtgcaatggctggatatcagctcactgcagcctcaacctacccaggctcaggtgatcctcccacctcagcttcctgaatagctgggactacagtcacacaccaccacacccagatcagttttgtattttcttcttttttttttttgagatggagtctcactctgtcgcccaggctggagtgcagtggcgcaatcttggctcactgcaagctccaccttccgggttcacgccattctcctgcctcagcctcctgagtagctgggactacaggcgcccaccaccacgcctggctaattttttatatttttagtagagatggggttttaccatgttagccaggatggtctcgatctcctgaccttgtgatccgcccgcctcggcctcccaaagtgctgggattacaggcgtgagccaccgtgcccagcccagttttgtattttctgtagaaatggggtttcaccatattgtccagcctggtctcgaattcctgggctcagctgatccacccatctcagcctcccaaagtgctgggaatacaggcatgagccattgtgtctggcccagttttacaatgttatgtacaaagcctcaaaggtgaaggatacagtgagccatgttcacgccaaaaaaaaaaaaaaaaaaaaagaaagaaagaaaaaaaagaaacaggtcacaaagtccctgctaataagactggttgcggtaaagaagccagccaaaacccaccaaaaccaagatggcaataaaagtgatctctggtcatcctcactgctcaaaatacactaattataatgtattagcatggtaaaacacatgcccaccagtgccatgagtttacaaatgcctagaagttaccctatatggtcttaagtggggagaaacccttagttctaggaattgcccgccccttttccagaacgttcatgaataacctaccccttatttagcatatgatcaagaaataactataagtatactcagtggggcagcccatgccactactgtgcctatggagtagccagccattcttttgtttctttacttctctaataaacttgctttcactttactctatgaactcgccccgaattctttcttgcacaaggtccaagaaccctctcttggggtctggattggaacccctttccagtaacacaatgggttcattttgcttgctgcccagatagagccagatcgggacctctttccagtaacacaatggttcattttgcttgctgcccagatagagccaatctgtcaagacaagagaaactgcactggggagagactttcattcacggctgaatgagagaccagagttttattactcaaaacagtctctccaaaaattcagactagggtttttcaaggatagtttggtgggcagcagggctagggaatggggagtgcccattagttgggtcagagatgagatcttatggagttgaagctatcctcttgggctgaagtgattcctgggtggggaccacaggaacagctggcaggtctgagtggcagtcgtcagaaatgcaaaaacctggccgggcatggtggcttacaccagtaatcccagcactctgggaagctgaggcgggcagatcacctgaggtcaggagtttgagattggcctggccaacatggtgaaaccccctctccactaaaaatacaaaaattaagcaggcgtggtggcacacacctgtaatcccagctacttgggagtctgagacaggagaatcacttgaaccgaggaggcggaggttgcagtgagccgagatggggtgccactgtactccagcctgggaaacagagtgagattccatctcaaaaaaaaaaaaaagaaaaagaaaaaaaaaaagaaatgcaaaaacctgaaaagacacctcaaaaggccaatcttaggttctacaatagtgatgttattgcaggagtaattggggaattgcgaatcttgtggctaatttattcgtcctaaaaagacactctggcaccaggcaagaagagggtttatttcaggaaagagctgttatcatcatttcaaagttaaactataaactaaattcctcccaaagttagttcagcctaaagttagttcaggaatgaacaaggatagcttggaggttagaagcaagatatagtctgttaggtcagatttatttcactgttgtaattttctcactgttacattttgcaaaggtggttccaggacttcaggaatatgccaccatgactggcttttaaaatttttttgtaggggtctcattatgtatcccagattggtctcccaactcctggtctcaagtgatcttcttgtcttcagcctcccaaagtgctgggattataggtatgagccaccatgctgggcctcatttaatttataattatttctaattagaattgaccattttgcccattttgtcagcagtttctttctttcaggagttgtctcattttgccagtcctgatatttttcttatagatctagacatgtttggcaacatgctccaaggagctacgtgtcatgttctcatctccgtggccatgccccagaccagagaatataatgcctccactgtgaaaatattctttccaaatgacagtgacagttatggcactcacgatttccacagcgtttcttcctctttttccttctcctggttttctgagtgtatttgttttcctagtttatcttactctggctgagtgaacatatgactggagctgtttccctaccttctagcacatgcgcatgttactgggaagggatcccaatccagaccccaagagagggttcttggatctagcaaaataaataattcagagtccataaagtgaaagcaaatttataggaaagtaaatgaataaagaatggtcactcaacagagtagccccaagggctgctggttgcccatttttgtggttatttcttgattatatgctaaacaaggggtggattattcatgcctcccctttttagatcataaagggcaacttcctgacattgccatggcatttgtaaactgtgatggggctggtggactgtagcagtgaggatgacaagaggtcactctcgtcgccatcttggttttgctgggatttggctggcttctttattacaacctgctttataagcatggtttttatgacctatatcttatgctgacctcctatctcgtcctatgactaagaatgccttaacctcctgggaatgcagcccagcaggtctcagcctcattctactcagcccctattcaaaatggagttactctggttcaaatgcctctgacacccactatcccttcacccctaccctgcactccagccatagtgaccccagagtgccctgcatccagctggtacccattgaacacaatttaatgaaataccacacatttgaggaggacaggaaggaaaagtgaaaaacatctgatttattttacttatttatttgagacggagttttgctcttgtcacacaggctggagtacagtgatgcgatctaggctcactgcaacctctgcctcccaggttcaagcaattcatctgcctcagcctcccgagtacctgggattacagatgcgcaccatcatgcccagctaattttttttttttttttttttaagtagagacagggcctcaccatgttggctaggctggtctcgaactcctgacttcaggtgatccgcctgcctcggcctcccaaagtgctgggattacaggtgtaagccaccttgccctgcccttatttttaaatttttatttatttattttaaagacagggtcctgctatgttgctcaggctggagtgcagtggctggtttattcacaggtgagatcatagtgcactgtagccttgaacacctggcctcaagtgattctcctgcctcagcttcccaagtagctgggactacaggcatatgctactgtgccctactaattttctttttaatagaacatttggtttcagtagcagaacttacttaaatttgtgagaaatgtctgctccccaatagagaacatggccctgcaaaacagtcttggtttactcatttcacaattttcccttcctcagttgacaactgtgaaatagggaaccaaatgctatcaaagatagctacaaataatatctgcgtgaggcagacaattatctgtgctgcagacccttctctgctttggccttaattccaaacaacagtaaaagcaaatccacaaaaccatttggggataggaaagtacaaaggggtatttactcacaggaaaaaaaaattaggacccttcattggtgtccagcacgtatttatgctccccagtgtcctgggggccttgcagacgcctttcgagcccatcacagacattaccttaaaatgcttcccagatttaactgaaagtaaacaccttcagaagggaaagtagactgaacattaggtaaaagcacccttgctttctaatctccagtgaggccaaaattgatcttatgagctcataagttgatctagaaaacacatttgtaataaatattttctatgctcttcaatgacaattaaaaaatggacactatataactaagatgggattgatcttatgagcttttaagttaatctagaaaacatttgtaataatccatgctcttcagtaacaataaaaaaagaacactatgtaactaattaagatgggagtagaaggccaataaaaacatctaatgtctagcaccaccttgtggtacaacattcaaatcccgagcccttacaaggaccccaagattaaaccttcttgaaaaagacttggttcatgagctgctctaccatttcgacctaacaatatactttctggagaaatacaaaataatagaaataactaacacttgactggtactttatagtaaaccaagcactcccatctgaatgatctcacttaatcctggcagcagccctgccaggtactaggtactaagatctcagtcttagacatgtggagtctgaagttcaaagaagttggtagtttgtactgggtaagtcctgcacttgaacccatttattcatattccaaatcctgtaataaaattgtattagcactattgtatggagtatgtgtgtgtgtatgtgtatatatatatacacacgcacacacacatcactatactatatgtattaatatatgtgaaaagttcaaaagaaacatatagtactatataggatattttaatataatatagtatttatactattttttatagtactgttagccagtactcactacgtttccggcgactgttttctggctgtgaagacaaggcaatattggttgactctttgtagtctatatgattccacacagtttgctactaaaccaaccatggtcttgctttcctagtccctaagcacccaaacgtgggagaacctgatcctctgttgtattaatttagggtgcactgatggaaatgtgtccagcgagaatgaacacaagaacctagaggcaatgagactgaagccatttttaggtttggcctttaatatgcttgtgaaccaatctactggctcatagttaaaatactgatggactgggtcacctcattaatttaacaagaagtacattttacaatcaacatatcttaaagttggcagctgcctgggcccacttccaaccctgacccagccatgaaaaaaaaaaaacaaacagttatatatatatatatatatatatatatatatatatatatatatagagagagagagagagagagagagagagagagagagagatggagtctcactctgttgcccaggctacagtgcaatggcatgatcttggctcactgcaaccgccacctcccaggttcctgcctcagcttctcgagtagctgagactaaaggcaccatgcctagctaattttttgtatttttagtagagacaagattttgccatgttggccaagctagtctcgaactcctgacttcagatgatccacctgcctcaacctcccaaaatgctgggattacaggcatgagccaccacgaccagcagttaatcttaatgtatcttaaatatatgagaggccacttgctcagtgtcagaggtcggcatgtcattaaaccagctttaaatattgtttttattgtttattttttgagacagactcttactctgtcacccaagctggagtgcagtggcacaacctgggctcactgcaacctccacctcccgggttcaagtgagcctcggcctctcaattagctgggactacagtggactacagacatgcaccaccacgcccagctaatttttgtatttttagcagagacagggttttaacatgttggccaggctggtctccaacttttggcctcatgtgatctgcccaccccagcctcccaaagtgctgggattacaagcatgagccaccatgcccagcttcacctttaaatattctaaatgaaaacttttgcagcctggctttatgggggttagaatttggggcataattactcctgtgggtagagacaactccaggttgtgtttggaggaaactgttggccccattcacaggtatatgcccagccaaccactggcaaaggaagacgacttcatcaacctgttttgctttctctgaagtcattcttacttgtctcttggccggatggtctgcccaatagctacccttctaagggacaataacctagacctcctggttcctagattcacatcaaaccctccactgagaacactattgatggaaaactgaccgaaggaccaacagcccgttagtcttctagggattctaaacccatctagaccagcccctttcagtcctcttcatccacttatttgactagtcctttgggggttatatctatgttaagctatattatcagaaacaatgctttgatacttgtgtttattattggtaaaactgttaagtttgccatgttgtagtgttctctttatgggaactagagggaaaggttccttagatctccagattaggggtagctgcctcaggtttatcgcatggagtctgaacttgatcttgtttccttctttacactgacaactaggaagcaaaatctgttatttatccttaagtgtataagacctgctgtaatgcagtttgtgtggataagattattttcctggcctcaacttttattttcctttagcccaatttccctacttaaaatcgtgtaatttttgtatttttgtaagttgtccttaaacttttttggggagaattttaaaaatagaagaaaaactactctctggtgttagacttcagaatagaggatatccttgtggggacagtgactggaacgagacacaggggtggcgtgggttctggggtgccagtcatgctggacgcgtcatacaggtatgttcactctgtgatgtcagtgagctaaatacttatgatttgtgcacttttctgtatgtatgttaagcttctatgttcaaaaaatgaggactgagggaaatgatactcacgtgccatatatatgtacttcctttaatcctctgaacacttttaagttagtagttatccccattataaaaacgaggaatgtgaggttcaaacaggttaaggaatgaggccaaaattccaaatgacttctgataacaaaagcacaggcttatcctactacactacactgctccttgctctttttttttttttttttcaattggacacggggtctcgctctgcacccatgctgtagtgcagtggtgtgataatggctcactccatcgctacagcctccaactcctgggctcatgggatccttcaacctcagtctcccaagtaggtgggactacaggcatataccaccatacctggctaattttcttatttttttcatagagatggggtcttgctacatcacccaggatcccactttcctactttaaatggcctgtctttatccagcttagccaataaaatccaagaaacattggtcagacctagtagagacacaggtgaaaggacttctacggagggggcagtgggcagcatctgaggctgaagctggctgtgggattcatttggcggagggggctttgggagacagcactggactgaaagtgcggagcttgaggctgcttctggacagggctggattctcactgtgagaaggcccatgaagccccctaaaggtccaccatctctacaagttccatcagcccctcccaagaagttgaggacagatggcagaatcacaacacccagcacgcacagtgtgagccctgctgcctgcccctcttctcttcaggagccaggatttattctgattgtacagaaccactatgactattatccaaccccttcacactgggacccctcctccagatgtagttggagttgaagggcccaggcctgctgcatgtgcagtccagtcatgtactcaagacagggttctcacaaacagctttctgcagaaaggcaaacagaaaggcttacaggctcaactcgtgagcagaacaaaataacctggattttacttcataaaggaaaagtcattaaaaggcaatgattgggaaagaggtcagcagaccaatttagggatttccccatattctgcaacactagctacgtgattttggactcatcatttaccccttgctactgcttcctcatttcccaatagggagttggaatgtccattctaaagcccctctcaactctgaaattctaactctaaactagacaccagtcatcttctccgagaaacagcactggacaaatggggcagaggggaggacaggtgatggccattccctctctcccccccagggcaaacaatgtggcaaggaactggcccagtgataaggggtctcaacaatcagatatggagccatggagggttcttgagcacagacagagcaaaagtggtatttgtggaacactggttttgaagaaatacataactgaactaaaggggagaccaatgggcaaatatgacactcgaaaaagaagaaaacagaacactcctttaggctagaaatatatatgagtgtcttattttagtctacttggcctcatttttccccatggttgtctgacatgttgcctgggggaacacttacagtcacatgagtaatgacaagaatctctttacgtgctacagggtccttaggcttttctttgtggaattttacagtgaacaatatggctaaattatgttattctataaaactttgactacttttcaggccttgaaattttatttacatgtctctaacacacacacatacacttcctattttttaatacaaaaagtacatagtagccccccgtatctgcgggtggtatgtttcaagacccccagtggttgcctgaaaccaagatggtaccaaactctaaaaaaaaaagaacaactttaacaatataccgtaataaaagttatgtgaatgtgatctttcaaattttttttgttttttttgagacagacttttgctctgtcgcccaggctggagtgcagtagcgtgatctcgacttactgcaacctccaccttccaggctcaagctaacctcccaccccagctgggactacaggcacatgccaccacatttggctaatttttgtattttctgtagagacagagtttcaccatgttgcccacactggtcttgaactcctgggctcaagggatctgctggccttggcctctcaaagtgctggggttataggcatgagcctataaccctcaaaatatcttaagaaaagtaactgactgcagttgaaaacaggtaattgaaattgtggtaagtgaaaccatggataaagcgggactactgtacatgctcattaaaaaaaattaagggccaggcatggtggcttacacctgtagtcctagctactcaggaggctgaggcaggaagactgcttgagcccaggggaggtcgaggctacaatgagctgtgatcacacaccactgcactccagcctgcgtaccacaagatcctgtctcaaaaaatatataaagtaaaaagagtgattttatttatttatgaaacagggtctcactctgtcgcccaggctggagtgcaatggcatgatcttggctcactgcagtctccgcctcttgggttcaagcgattctcttgcctcagcctcctgagtagctgggattacaggcactcgccactatgcccagctaatttttttgtatttttagtagagatggggtctcaccatgttggccaggctggtctcaaactcctgacctcagatgatcccccaacctcggcctcccgaagtgctgggattacaggcatgagccaccgcacccagacgaaagagtgattttaaattttcctcttcaagggaaggtataaatgccaacctcatgaaaggtcaggacttaggatccaggcccaggaccacaggagatgggttcttaggaggctttagaaatttgctctgaaggaaaactcttggcacacacaggccttcttttttattcaccgtctctcgaaacacatactcgtttaccacttcttcataacctgtgtccataaagagctgagccaggaagtctgtaagacaagcatcaacaatgctcaacagtcttcataacattacatttgctttgcagtccttgaggagggatagagggctgaggctattttaatatttttttaaatgaaaacctcaatgctaaaatttaaaggttttgatttgggaactaatacactccttctcctcttctacccaaacagaaacctccaattaaacaattaaatcagaacaaggtgaaggacaacctggtgttcgcatcttgccttattatgaattctcaaatacaaaagcccgagtaaaaagaaacaattccaaattggttatattcctttttttttttaattaaaaaaaaatttttttttgagacacaatgtcactctgtcacccaggctagatcaggagcacgatctcggctcactgcaacctccgattcctgggcttaagtgattctcctgcctcagcctcttaagtagctgggactacaggcacacactaccatgcctggttaatttttttgtatttttagtagagacagggtttcgccatgttggccaggctggtctcaaacccctgacctcaaatgatcccccaatcttggcctcccaaagtgctgagataacacgcatgagccactgggcccggccgattatattcctttttaaaaattatcttattgtttcccatctccgaacaaaaacataaaaattggctatactcctacaaggtctgcatgtgctcaatttgtttacatcaaacatcttattcatcctaacacgaaggaggaaaatttgtgatcagagtggagaaaaacacccagtggtgacctagctccaggaaaatctaacccaaataatacatcactacacattaaatgaaacaaacagaataaatggtgaggcagcaaaaataaagactcgtactaagagcattgctccagagaacgtgctctgaagcactctgcagatatcactgaatcttctcaatatttacaattggtttaaattttatgaattaaaacatcttttgaattttaacctattttgataattttgcattttgttttgttttgttttgtttttttgagataggcttctcgccctgtcgcccaggctggagggcagtggtatgatcatagctcactgcagcctccatcttctggggccaaatgatcctcttgcctcagcctcctaagcagcaggaccacaagtgcatgccaccactcctggctaatatttttttttttttatttttagtagagacaaagtttcacggttgcccaggctggtctcgaactcctgagctcaagtgatccttctatctcagtctcccaaataattttgcagctttaatagtaatcactcaattttaattcattttggtatctaaaagaatatttcatttcaagaagaaaaatgtttgttaaaatagaggttaattatcttcctgtctagatgattaggtagactatgttcaagacacctaaaagaccaaaataatgttccacattttcttatcaaaaatgactttttaaatacctctttaggctgggcatggtggctcatacctgcagtcccagaattttgggaggctgaagtgggcagatcacttgagaccaggagattgagaccagcctggccaacatggcaaaaccgcatctctactaaaaatacaaaaattagttgggtgtggtggcacacacttgtaatccttgctacttgggaggctgaggcatgagaatcacttgagcctgggtggtgggggttgcagtgagccaagatcatgccactgcactccagcctgtaagactctgtctcaaaaataaataaatgcctctttacagcaaatttgcatatttatttaaaaacagatccaggacaggcatggtgactaacacctgtaatcccaccacttttggaggctgagacagatggatcacttgagctcagaagttcgagaccagcatgggcaatatggtgaaacccccattctaccaaaaatacaagaaattagccagccatggtggcatgtgtctgtggtcccagctactcaggaggcttcggtggatcacttgagtctggaaggtggaggctgcagtgagccaagatcacaccactgcactccagcctgggtgacagaattagactctgtctcaaaaacaacaaaaaaaccaaaccccaaaacagatccaatcaattctacagaaaaaggtttcctgactttgtgccatgggaaagtaatctcaaggcattatactgtcaaatttgctttatttttaactggacaagaagtttctgacttgccctccctcttattccagcacaattcctagtagggaatccacatggcatgtcagaggctgtccattaacccaagctcattaggggagtcactgacaccagagaaggcttgtgagctcttcaagggcaggggccaggtctgtgccttccaggtgctgggtaaatattgtgcagtagagggcttgtttcagggtctcgtgcacatgtcgcaagccttctccaagcagccttgcagtgataatgcaatcaaataaacagaaacaaagaataaaacatttaaagactggattccattcatcttaccatcagtaaaaaaatatgatctggtcccatcttgtctaacataaaagttttctccaagtttgctgctggctttaaacctaagcatggcatgatcatacagtccgtagtcacgaaacaagacacttttgcctggttttaatacctatgaaacaaaagcaggctgaacatgactttggagaaccctgtcaaaataaaacctgattaagttaggacttaaaataaatttgtgatagttactaaggggacagactgaaatgcccataatacggaaccaaaatggcctactacttaaaaagatagtaagaccaggcagggctccataacactaagacacttcttttttttttttttttgagatggagtcttgctctgtcgcccaggctggagtgcagtggcataatctcagctcactgcaacctccgtctcccacgttcaagtgattctcgtgtctcagcctcccgagtagctgggattataggtgcccgccaccatgcccggctaatttttgtattttagtagagatgaggtttcaccatgttggccaggctagtctcgaactcctgacctcaagtaatttgcccacctcagtctcccaaagttgggattacaggcgtgagccacctcgctcgtccctgaagacaattcttgagtacctccaagagcaccctggaatgtccagtgtcacaggattaaaatgttagagaccaacctgggcaatatagtgagaccccatctctacacaaaaattaaaaattagctggatctggtagtgcgtcctgtagtcccaactacttcagaggctgaggtgggagaactgcttgagcccaggaagttgaggctgcagtgagccacgtccatgccactgcactccagcctgagtgacacagcaagaccctgtctcaaaaataaataaataagtgttagagacaataaatgaaagtgttatcctcattgaagcactttcttgcaacattttattcaccatctcctagtactcaaactgtattcaactgtctcttaaaaaaacaaacaaacaaacaaacaaaaaaccagaatgtcgttttggctctttactgattcaggttggttttcctcattctgagcctcagctctcatttcattgtgccacaatgtatagctcaatcacggtgctaatgactgatacatgcctagcatttgactgcttaaccatacattttctcattgtatcttcacccaactgtgggacaaaggaatgtgattattattctcacatgagacacggaaaccaatactcaacagggttaagtgatctgccaatgatcatacattagctttttttagacaaggtcttgctatgttggccaggctggtttcaaactcctgacctcaagtgattcacctgccttggcatcccaaagtgttgggattacaggcatgaaacaccacacctggccaaactgtgtactcttgaccactaaaccataactcctctcaccttatagcaggactccatggatcccaggtaactgcaaaatcatccttgtcccagggctggcgaagctctgaagagcagccatggcactgcacaaatcagaatttagggtggatgttttatgccagaggacccctttctatacactcactacacagcctacctagtgagaatggagagactatgtgaatctagacagtacatgagcctcatgagggaaggtaagtaaaagaatccagactgtccaaccctcaagtgcaggccccaaatcactaaccttgtaaatgttttgtaagacaaggtgcatcttatcaggatgaacagctgacagcacaaatatcaacataacaacatccacagactctggcggtacatgatccagaagatcatctttagtcagatcacactggaataccttgcatctttctgtatcatataaaggattttgctacagggggaagaaatacaaatgaattttaatgcaaccactaggctgatacatatagaaaaatacaacatcaaaaggcgatccaatttccacttgtatacatagaaattatcactgttaccagataaaactgattaataaatcactcactataaagcatgtaatattcactactgctacaggagcaagacttcattttaataaatcatttttaactgaggagacaataagagtatcacgtactcaaaactgagcattttagaagcatattatttccagagggatgatgatccaaaactggcctctgcttctttttgttttttaaagagacagggtctcactctgtctgctgggctagagtgcagtggcatgatcatggttcactgcagccttcacctcctgagcccaagttatcctcccacttcagcctcctaagtagctggaactacaggtgtgcaccactgcatctggctaaatttttatttttatttttgtaaagatgggatcttgctatgttgtacaggctagtcttgaactcctggcctcaagtgatcctcccacttcagccttccaaagtgctgggattacaggcatgagccactatgtcctgctggcctctggcttccttaatcctcctttgaatcatctgcttaaagcctaaaccctatgagaagcccttctaattccccttgatgagatgctcccgcagttcttctggggtatattttctctttatgcagcaagctaaataaacttaacctttttttgactacaaatgtgttcctggtacattttggttggtaggcttcaacacatgtataggagtattatgaagaaaaacattaaacttctatttcatgtaaatgaggacctgaataaatagatatacaaagttactggatgggaaaattaaatgcaaaattaaaaagatgtcaattctattcataattccatttgtaaatccaatgcaatctaaactgattcccaacagatttctagaaactagacagggtgaatctaattcatcataaagtaaaaatctttaagaatagccaagtcaatttttaaaatgatgaacaatgaggtaggtatggtggctcatgcctgtaatcccagcaacctgggagactgaagtgaaaggatcgcttgagttcaaagctgcagtgagctatgatccatgccactgcaagctagcctggaaaacagagcaagatctcatctttaaaaaaataggccaggtgcggtggctcacgcctgtaatcccagcactttgggaggccaaggcaggtggatcatgaggtcaggagtttgagaccagcctggccaatatggtgaaaccccatctctactaaaaatacaaaaattagctgggcgtggtgacccgcacctgtagtcccagttactgggaagactgaggcagaagaatcgcttgaacctgggaggcggaggttgtagtgagccgagatcatgccactgcacgccagcctgcatgatagagactctgtctcaaaaataaataaataaataaataaataaataaataaaatagaatgaagaataataaaggagaagatacactactggatatcaaaatatattacaaaacgtagtaataaaacaacatggtttgagaatggagacaaatgtatcactgagacaaaacagagtcccaaaacagacctgtatatactgtatatataaacaggaattttgtatattatatgataaaagatagacaaaggtgacaattagacaaaaaggtagataataaagatgacaattatgagtgaggaaaaaatttctcattcaatttactgtgtttagaagaactggctacccttgagacaaatgactacccttgagacacaggcccacggtaccagttcaaatttggagaagcagaacattagagaacgaccccctctcccacaccccaccatcgaatctccaagaataacaggaaattgcagctgggagagccacaacagatagactctttgggaaacggtacaaagggaagacccaaatccaagagaggagacaaaaacaagttgctagaggggtttgaagtctctggtgcccacagcaacaacaaacctcacagacagcaacaacagacttcaaacaacagcccaattcctgactagattgttacaaatccctatccctcagtatctactggcccttataatatgtctagctttaaccaaaaagtagaaaacatcccagaaggcaaaaaacatagtgtgaagagaataagccatcaccagagccagactcaaatatgacagatgctggatccaaaagcttgggcatttaaaataattatgattaaaatgctaaagactctaatggaaaagacagacaacatgcaaaatcagatacataatttcagggatggaaactataaaaagactctaagagaaatgctaaaaaccaaaaatatggtaaaagaaatgaacactttcaataggtttctcaacaaaacaggtactgcctaggaaacagtcagtgaacttgatgataggataatagaaattacacaaactgaaaatgcaaaaaggaaaaaagtgggggaataaaccctataacaacagcatctaagggctgtggggcaatagaaaatgttacacacataactggaatcccagagggagaagagagaacaagagctaaagaaagaattcaaagaaataatgaccctaatttttccagattaaaaaacataaccaaaattataaaataactatataaccaaaaattagtaagagcaatatataggtgattatgtctaaatcctaggaatagctgggcgcagtggctcacacctgtaatcccagcactttgggaggctgagacaggaggatcgcttgaacccaagagttcgagagcagcctgggatagtgagacctgatctctaagaaaaataaagtaaatcctaggagtaaaggactcctaaacaagacataaaatagaacttcaaaaggaaaagattaatattttgccatgataatttaaatcctgtgtagcctgggcaacacagcaggacctcatctctacaaaaaatttttaaaaattagccaggcatggtggtgcatgcccatggtcccagctcaggatgctgaggatcacttgagtccacaaggtcgaggctgcagtgagctgcaatttgcaccactatactccagcctaggtgacacagtgagaccttgtccaaaaataaaataaaataaatccttgtgtaaaaaaaaaagagatactgtaaagcgatgctgaataaactagaagaaatgtttgcaacatacataccaaaatatctagaatatatcctgaaaataagaaagaaaatgacaaaccaatagaaaaatgggcagaggttatgaatggacaactcctactacaaacttcatgtgggtgggaatttttgcctgtctgttcactgtttaactccagtgcttagaacagtgactggcacacattaagctctcaataaacaaatgtggactaaataaactcacagctaactattgctatcaaccttccacaaggccttcaacctctctggtaataaggaaaaaacaaattaaaatatggaggcattattttttgtccaaaagattggtaaatataaaaaagactgatatcaagagttgaggcaatacagaaaaaggtacctttacattattggtgaaattataaattagtatgagctttttggaaggaaacttggcattgtctattaaaatataaatgagcatgctcttcttccaaggaattctgcttcttccattattcatcacagacaaatgtgtacagacattttgggaacatatatatgatgctgatcacattaaccctatttgtaagagcaaaaaaatagaaacaattcaaataaatataaatagggtaactgtttttcttttttttttttttttttgagacagagtctcgctctatcacccaggctggagtgcagtggcatgatctcagctcactgcaagctccgcctcccaggttcatgccgttctcctgcctcagcctcccgagtagctgggactacaggcgcccgccaccatgcccggctaatttttgtatttttagtagagatggggtttcaccatattaaccaggatggtctcgatctcctgacctcgtgatctgcccacctcggcctctcaaagtgctcagattacaggtgtgagccactgcaccagccaggtaactgttaaagtatgctatatccattccatggaatattataacaggtaaataaaatctacatgtactaacatgaaaaactctgcaaaatataataatgtagaatgaggaaagcatgttatggtaaatatgataccacaactatttttaaaaatctactgtgtataaagtggacagacttaagtccttatttaaaacatcgagactttctagatgtttagaagtgcacaaagtatgttaaaagtagggtagtaagtaacacattttgtagatatccttttgttaaaattcactgaaatattaccttttggaaatgtaatgatcaaaccacttctctaagcagtacacatcattacatttgtactgcgtcaggagaaaaggaggagaataaagtgcaaagggctttataccaatgtgtttacagtgaggcaagattgaccactgtaccttatgtccatgcattttattttactttgctatgtatatagtgtatatgaaggacaaatgagccctaatttacaacatctagttctagatgttaaagaggttgacagcgtatgaccaacgtagagtcagtaacctaatacactgagtacattttgtgttcaaattcataggaaagactgttcttaaaaacacttagggaagtgaaattgttaaagtcccctctaagcactacaaatgcttatatctatccactgagttgacaggtgggaagggttctatgccagaatgttcgttcctatttagatgacactttcaaatggcagcttattatgtacgtgtaacatttattcacgttttcagttcttaagaaggactatcctctgggagtgacctttgttaattgacctcttagaactagacatagtcctgtacttagtcactggaatgacagaacaggataaagaagaacgggtggaaggaagggctcttagtcagaatctccatatctagaagatggttttagatgaaaaaccacaggtctataggtgcatttttagtaaagtacttgtgtttattgtggacagagtttattattttgcaacacctaagcttcatagatgtcttgatgtgacaacatataataatataattagtaaatatccataatgtgtgataaaacacgatacatactgcgtgatcttaatcccataaaattggatactgtgtctatgtacacacaggacctagaaggacaagtcaaactgtaaactgcttgtgattgtggatgactgttctttgcttcttgtgtttctcagtttcctacagtaaacatattaactttttaaaaataaagggtttgggttttgttattttgagatagggtcctgctttgtcacccaggctggagtacaatggcatgatcatagctcatgcagcctcaaactccgggctcaagtgattttcccacctcagtctcccaaacagctgcacacgccaccacacctggctaattaaaaaaatctttttggccaggtgcggtggcttatgcctgtaatcccaacactttgggaggccagtggatcacctgaggtcaggagttcaagaccagcctgtccaacatagtgaaaccctgtctgtactaaaaatacaaaaaaattagccaggcgtggtggcaagtgcctgtaatcccagctacttgggaggctgaggcaggagaattgcttgaacccgggaggtggaggttgcagtgagccgagatcgtgccactgcactccagcctgggcaataagagtgaaactccatctcaaattaaaaaataaaataaaataatttttttttgtagagacagagtcatactttgttgcctaggctggtaaggttactattttcaaaagtctaatgtggctgagtgtggtggctcacgcttttaatcccagcactttgggaggcagaggtgggagttaatcccagcactctgggaggcagagatgggaggatctcttgagcccaggagtttgagaacagcctaggcaacgtagtgagacccgtctctacaaaaaaataaaacaattagttgggtgtggtggtgtgcatctgtaaccccagctactcaagaggctgaggtgggaggatcacttgagcctgggaagtcaaggctgcagtgagtcatgactgtgcaactgcactccatcctgggtgacagagtgagaccctatctcaaaaaataaaaaataaaaataggctggatgcggtggctgatgcctgtaatcccagcactttgggaggccaaggcaggcagatcacttgagttcagaaagaccaggctgggcaaaatggagaaaccctgtctctacaaaaaaatacaaaaattagccaggggtggtagtatgtgcgtgtagacccagctgcttgagaggcagaggcaggaggatcatttcagctcaggagtttgaggctgcagtgagctctaatacacaccactgcactccagcctgggtgacaaagcaagaccatgtcaattaaaataataataataagattaacttaaaaaaaaagtttaaattttaaaaagtctaacgaatgctaaaactgtgaaaggttgatggggaacgagatacttgcaatgtcaccaaagtgttccccacatattggttaatggcaaagggaattttacaatggaggaattaggtagttactatcttaaccctgtgatcaaaaccagtaagatctccagatattattgcctcatgacaggatgtaatatgcaagacacaacattacctattaaagcatttttgccaaaaatattttacctgatttaaatttaacttctagttcacagataatatagaacatagaggaataaattaaacagtaatgcaaataaacaattagaccaatttggaaatttactatagaaaattggcttcatctgtcatcaatgtggaaagaggtatggggtagggcaagggtattttaggttaaggagatttaaaggacataagtgagccaggcgtggtggctcacgcctgtaatcccagcactttgggaggccaaggcgggtggattacctgaggccaggagtttgagaccagcgtggctaacatggcgaaaccccatctctactaaaaatacaaaaattagccaggagtggtgggcacttgtaatcccagctacttggaaggctgaggcaggagaatcacttgaacccaggaggtggaggttgcagtaagctgagattgcaccactgcactccagtctaggcgacagagcgagactccgtctcaaaaaataaactaaaataaaaaataaaggacataagtgtaagaggtagtgcttgactggattataaacagctataggcagggtgtaatcccacactctgggagtctgaggagggaggattgcttgagctcaggagtttgagaccagcctaggcaacatagggaaacctcatctctacaaaaatttaaaaactagccagggtcagctgccatggctcacgcctgtaatctcagcactttgggaggctgaggtgggaggattgtttgagcccagaagttcgagaccagcctgggcaacgcagtgagaccttatctctaaaataaataaataaacaaataaacactagctgggcacggtggcacatgcctgtagtcccagctacttgggagactgaggtgggaggatctgcttgagccaggggggtcaaggctgcagtgagttgtgattgggccactgcactctagcctgggtgagagtgaaaccatgtctcaaacaaaaacaaaaacaaaaaccagctataaaagacacctggaagccaggtacagtggctcatacctgtaatcccagcattttgggaggctgaggcaggttgatcacctgagcccaggagtttgagaccatcctgggcaacatagtgagaccccatctctacaaacaattaaaaaattgtctctgctacttgagaggctgaggtgaaagaatcgcttaagcccaggaggttgaggctgtggtgagccatgttcatgccactgcatttcaactgggtgacaaagaacccatctctaaaaaaagtaaaaaataaaactaaaagacaccgggaactatttggggaaatctgaatttggaatggatgttaataacattgggggattatgttattttatttgtttatttaaagacagtcttgctctgtcacctaggctggagtgcagtgctgcaatcttggctcactgcaacctccacttccctgactcaagtgatcttcccacctcagcctcccaattagctgggattacaggtaagcaccaccatgcccagctaatttttgtatttttggtagagacaaggtttcaccatgttgcccaggctggtcttgaactactgggtgcaagctatccaccagcctcaggctcccaaactgatgggattacaagtgcgaaccaacatggcaggccagattatagttatttttgtgaaatatgataaacttattgtggttgtgtagaaaaaggccttttttaaggggagatgtatgcaaacatttaggagtgaaatgtcttgacatttgtaatatactttaaaatagttcagcaaagaaaaattgtaaagcaaaagatgttaattatatggatgttattatggtattttttcctgcttttcttgaataaagctgtgtttctacatgcactgtatatgtatgtaagcaggacaactacatgtatggtgactatagctggttagctccagggaagactagaattgggcaaatgaataaaaaaggcagatcaaacaagatcggcaagaaaacagaaacacagcagaatacatagatggtgcaccaaccttaacatattcaatggctcttggagaaaaatcacaggcataggcaaagatattcggatcttcttctaaaagtgggaataaacagtttccaaccccacagccagcttcaagcattgttaacttttgatcttcaaactggggaaagacagctcaaagttatagtatatcacatttgcataatgaagaaataaaccaaactaaaaggtccagaatatgagaggtctccgaccccatggagcagacgatcaacaagagaactaataagcaaaagctaatactggtacttcatttgtcatccaacattaacaatttggtgtggaggaaaaaaacagcacaatggctaactcggctctggagttaaactgccagcacccaaatctcaactcctcccctgcattctatccttgggtaaatcacttaaacagctctgtgcctcaattttaccttggggacaaatgagtacaatactaatacttacacttcacagagccggtataagggtcaaatgataggccatgtagaaaacagccatggtaaatagttactaacattaactattatattattctgaatctgtcactgaagtcacttagcatgaatttatatttttgtttttaaaatttttaatgtttaaaattttaaaattcagaacatagggtctcactatgctgcctaggcttggctaattcatgttgactattcacaggcacaagccgcctgcctcagcctctggagtagctggcaatagccaccagacctggctcttgaatttaatatataatgtttacaactatcagatcagcttaaagaaatagaaaacacccactaaagttctctctcctatatgttaaccaaaccagaaactgctaaaactttggtgttaagaccaaacagtatatttctctcctaaaacgcaaagcattttgataggcttcttaaattctctacttcgcactctccctaggaatgcaatacagcacacctcttcacatttttttttcttttgagacagagtctcgttctgtcaccaggctggagtgcagtggcacaatctcggctcactgctatctccgcctcccgggttcaagcgattctcctgcctcagccttccaagtagctgggactacaggcgagcaccaccacacccagctaatttttgtatttttagtaaagacggggtttcatcatgttggccaggatggtctcgatctcttgacttcgtgatccgcctgccttggcctccccaagtactgggattacaggcatgagccatggcaccctcttcacattttaaatgaagaacagctcagataaggcgtaatattagcttacctctctacatgatcttagctcctcaaactctctggtggtccagtgtctgtctttgaagaaattagtgctatttcttttgtaaaaaagatcccaatttttctgagcctcttgttccaatttctgctgtttaaaatcagacaccaaagtttggtctcttttcagtttctcctcttcttcagaggtgagaatccttgcctgcagccctttcctttgcaaagaagccatctctgaaactgacggtaacacttaacacagctgaagattctccatcaccaaataatatgaatccacgctaatggatcagatacatttcctgaggtgagtttcacgcctcaaacagcacagggggcttcgcagagaaaagaattagattctggttagtggttacagttcaagacgccaggttcaattcaccaaatgtttatgagatgcagactgtacaaaaaaaaatccttcccgctatatgagaggtcacaaagaagacaaacacacagtccctaccttcagtgggcttacattcatttcagtggccagactatctcatgcaccatacttttattcaaaccagatgagtcaactattacaataaatcgatttagtttacgaaaaaggacgctctcaagaactgactgggaaaccttgcgaagaaaatattcctcaattttcggtgcccgcgaaaggggtgacttaaaaaccacaatggccttagctggaagcgggtggtcaattgtcagatacaagtgaggtcatcgtttcccaagggtcggacctccgttttttcgggggaaatgaagctaagcctgggtgggctcatttcctgatcacactcacaagaggctgtcataggaaccagagggagcgtcactttgcagggactgagaccctcgcaccgccatcaccgggcaaagtggagaaagagacccaatgacgcgtggctgaggtcccgaggatccatctcaggaccctcaggatagactaggctgcatgggcccctagaccctgaggagggcgtccatgatggctagccgacccgcgttaatttagtcagccacgctcagggctcaccgtcatcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttgtaagtcagcgctccccacggttcccttcggccgctccagccgccacatatcaaccttgactccttcctttcttccctcggcccttcagattccagggaaccccctgccagcgtcagttactttctctcgaaccccaaatcctttgggacatcgatttgtcccttcttttacccagattatttctcccaaatcttcgtcactccctactattcttctacctcacagtctcaaacactagttccaaaggtctttggcctctttccatttccatccctccccgcccccaacctcgcccctaaggcaaacctccctcccccaaggcaaacctcccccctcttatccgggtccacttctccctcgaaacccctcccctcctttccgatgctcccatcagggttctccacatttaaaagacgcttcttgtttgttatgagcctcatccactgccttagaacccattctcttccctgcttttctcctccgacttggtcctggactcccaaatactgtgctttgtcccctctacagccaaagaattggcatcctctctgcgcctcatcagagtcttcttccatctcctttctgtgcttcatttgacttggatgtcttttgaggtcacctataccacccgggcttttcctccagaccaagttccttgtgggtaaagagtcaaatcagagttcgtgagcctgggataggttaaagattggtctacgtttggaagcagaagagagcaggcgtaaggaatgtccaaatagtcattatgccggacctttttctacataattatagacgctgttgagagagtgcacttccaccctatgtcctgggtgaaggtttggcagttaggaattggctgacagagcatccctccgtgattcatgaacttctggtttccgtggtgctaacgctgttgttaagacttgtttttgtcagaggacctaatagatgtgactcaacacatgtgaagagggcgttttagataatgaaatcccatctttgtgtagtcacttgccatgccattgctatgcttcctactgacagcagatccagctctttcagagagaagagatgggaataagataagaacatcatttcctgaagagtttactaagttgatgttttcttttggtgaagggcaatgtggaatttaaatcatatagttcatgtgtgcacctgtcctgcagtttgaggcaggtgtgaatgtgaattaagatggctattatgttgtattctaactgcagtttagaaacacgagcaggataacttgcggagatacagttcagttgtctgctatgaacatctacgaagtgtctttgttaaagctgtggaactggctgagagtggtggctgacactataatcccagtactttgggaggccgaggtcgacagatagcttgagcccaggagtttgagaccagcctgggcagcatagtgagaccccatcactattaaaaaaaaaaaaaaacaaaaaacagctatggaacttgagtatggcaaatcctaattttgacagtttctatgcggaatgaaatcagcttttgatgatgctgtggcctttcatatttcatatagagtttacagtcacagaatctgtttcatatgctgttacttttgatcctcacaaccctaaaaaagcaacttattatggatgatgagacaattttcctctctcccttgggagaagggaatatctttgtttaataaaatggcctgtaaattcttttttccctctagaataatcaaaagggggtcagaggaaaagtatgtggaggtgtagatgaaacaagattgtccctgagttggtaataattgaaactggataatggtataccaggtctcattgtacgattctctctacttttgtgtatctgaagttttccataacgaaacagttttttaagaattctaaattatttttattttccattcatctgagtaataattttaattcttaaatggagatgcccaggaaacccttattataagtaacctggtgggtaagtgctttttttcctttccctttagatgattttaaaccagcatctatagacacttcctgtgaaggagagcttcaagttggcaaaggagatgaagtcacaattacactgccacatatccctgtgagtttatttcatttttttttttaatgtaagatcacaatgaatctttgtcttttatattattgcaatttaaacttcctacttttaaaaatgtttagatttctaaagtggcaacttaaggaaaaaagtaattttggggagtggggtggggtggacttcatgctaggcaggtgcttgattaaaaataattcttgtaatcctagcattttgggaggtggaagtgggtggatagcttgagttcaggagttaaagaccagcctgggcaacatggtgaaaccccgtctgtaccaaaaatacaaaaaattagctgggggtgatggcacatgtctgtggttgcagctgcttgggaagcggagctgggaggatcgcttgagcctgggaggtagaggttgcagtaaaccaagatcacgccactgcactccagcctgggcgacagagtgagactccccctcaaaaaaaaaaaaaaaaagattattcgtcgttttccccaatcttccttttcccccatctgctactgagtagacaaggttcctgtctggacacctagcccctcttttagatatagcttttctcccaagcaactccagacagaaaagccctaggtgccctgctgattatatggccacaacagctcaggagtgtgaggcaaccaagccaggagttaaggcaggcaggaaccacaggtgtggcacattcagctgatttagggatgaagaactaaattgaaagctggattaagaacccttgcagagaaagacttttgtgaagctctgcccaaggcagcactaatgacaaagcaccaaagggtcacatgatgctcttagtgaacatgtgttattgcatgtcacacccctgtcctggaacataagttctcggtagctggagacagaatgaaaagtctctggacagggagatctggaaagctttgtggtgaggaaaaattgcccattcaaactgctgtttgattacttgttacctttggcaagttacatcatctccctttggaccttagtttcccatatgtaaaatgaaaggtttagaaaaatggtccctaaagttctttctagctctatatttttactatataaataaggagtcaaagagccaagcagttttttattctaagcaaggcattaaatatgatattcaacaaatattaatcaaatgcctcccacacattggcccattactaggcatgaagtatataaccttgaacaaaacaagcacatttcttgccctggtggagcttatggtctggagtttaaattaatacaagaaaatatagcagttattctacaaaatcagggacagcttccttaaggaagtatctgtgagcagatctggaggttgggtcatttaaagagagggggcaggatatagctggcagaagccttgttaaagctggcagaagccttgttaaagcccagaggcaggagagagcttgaggataggagggaagccagttgccttctgctctgaagcacatgcgcaggggagtatgctgcagggtgaggtggagagccagggaagggcccggtagtgcaaggccaagtggctagtttaaagattttatcctttggcctgagagcaattgaggagtgattgaaaggcttaggcagatgagtgacatgatttatttattctgagccaaccaggataatgaccttctcttggaaaatgctctgttggttgcttgacatgagaaggggaaaccctggtctctctaatgacaaagaaatagagatcactcacagttttactatacagagtgataactctgcttagtataatgaaagtaatggttaatttttctctcttggaacgtatatagtaattaaaacttttatactacctttttgattacttagaacgcgttgcacattcacaaattcttgctatattatttctcctttatttttgcctcggaaaccagaaggagataaaatagaaatcagttcaacctgttctttttgaatagctctgataaaagatttcatcaggtggagtcatctataaattcagttgatattcataactggtatgtttagtttgatcatcttatacttttgtggcaaatagggatccacaccacccatgactgtgttcaaggggaacaaacggccttaccagaaagactgtgtgcttattattaatcatgacactggtgaatatgtgctggaaaaactcagtagcagcattcaggtgaagaaaacaaggtatgtgaatagccagatgcaggtttatatcatgtttccaaacctctgttatctattcagtttttataaggttgtgaacatctgcttgctcatagtgttctatcaataatcttaacactacctgtgctcagacaaaatatgtaaatatgtgctcagagtaaaatatgtcttcctcaaatgcaataaaaagaaataatgttttttaagacctaaaacatgggaaccattagggaaagggggatatactttataattaagcctattttgttaatctcatgattgctacagtaccacctaagggataagataacttatagacttataattatgaaggagcaatatatactatacttaactggagtgaaaacattaatttttttacaagatacatttgagattactataataccaaaataaaactttgcctattttttaatatagtgaactctttaattcaacagttgctacatgtctaaaatgaagccagttagagtttatttgaaaataaaaattcattctataaatagaaataacctagtggttctatttgttaccatataatacagtatttttttttttttaaagagtcgaggtctcttgctgtgtcacccaggctggagtgcagtggcataatcatagctcacttataatacagtaattattataatacagtaattaaattgtaaagattgtcacaacctgatgttttttatgcttcgttaagccatttttttttcattcattcattccacagaaaataaaaataggtaccatttattgagggggtatcatgtcccaggcactctgctagatgctttatatgcattgttttatctaacaagtaatttttagaaaggtgttattattattttttacttcttttgttaaaaatatggaattgttcatgagtttgtgtgtcatccttgcacaggggccatgctaatcttctctgtatcattccaattttagtatatgtgctgccgaagtgagtacgaaaggtgctattatctaaaaaaaaaaaaaaaaaaaaaaaggtacggagactgagggttagagagcttgacctaccccggagagtgtgctgcagagtccttgctcctgtcctgccactctatttatttgtattcattacctacagtgaaccaggtgctaccgatattcctccaatatctgatggttgtggtatattcccttactactcagtgtgatatgggaactaacagtatcatattacctagatgatatgcagaatctcaacacctatgagatctgaatctgcagagatcaccaggtgatttgtgcataagcaaaagttttagaagcactaggctagtccatttacaaaagaaattgttaactgatagaatattctcagcttgggatggaattctgcttgtctgccagcaagagctggcatgtgatgaaatgaacaagcagtatatagataatggaaaaaattttcaagctgggcaatattttaggagctactttatttaggaactcatgcactcatgattataattacataatgatgttttggtcagtagtgacctacatatatgacagtggtcccttaagattctaatggagcatgtatggaaacctgatatacggcacttgatattggcattgcagatcaagtagggggaatgactgatattcaattatggtggtgggacatttgggttttcatgtgaaaaaattatatgctatattggtttgcataagtacattctgctgtttgcatgatgaaatcacctcatgatgcagttctcaggacttaccctcattgttaagggatgcatgaatgtattttctactagtaaaatggattttcatagtttcattatatcctacatttgtttgctatacatttgagctcatcgagggcagtaaatattctattcatgtctgtatccctgatacataatatagtactggattacagtagacactcaaatgttgaatgaatagctcacatgacaaaattacaagtatcagtattttgaagtggtctggaaagaacatggggttctacagagacttctgagttttcagtcacctggacaaatttgagaaccactatttttgccctgctaatttaatgtctgtatctcctttcagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagaggtagagaacattttctggatccatgatagcaacttggagtagagtgctgaattttcttgtggagatcacatggctgctgtattgatacagtggctggggcattcaatgccatcaaaaaaatgtctgcagagctcactgttcagagatggggagggtgggggcttctgccacttacctcatttgacaagggtgagtcctggaatagtgacttgagtttgtggctatctttgtagccattctgcttagaggcctaggatttaaacaagcatgacttccatctaagctccatatggcacacctctaaggcttcggagaaagaaaggattctaggtgttggaggtgaaaactaagcgtaggtggcaacctttctgagctctacattagtatataggctggaggagctgaccatggtgctgcacacttgtagtttcagctactgtgaggcaggaggatcgcttgaagttgggagtttgaggctacagtgtgctatgatcgtgcctgttggtagctactgaactccagcctgggcaataacatctcttttttggggggaaaaaaaggattaaaatgccttttaaaataccataagcaaatgtcctgtgctaacacaaagtgtgtaaatatgaaagaggccatgaggaccaatagaaacagatactggcctagaaagagttaaaggtccagtttggttctctccactgcaaacctgagacaaaaaagcttaccttggctttctccttcacacgatgaatggttttagtcctccagactctttagaagttgtgaggtcatatttcatatttataagttttataaaataactaaatccataataatagtagggaaacataaagagttgtccctgggaaatttgccttttccaccctgtagaacggctgcagacatcactctgcactgtgtacagttgttttgtccctttttttttttcctcatggatactggaatgctgttatggaagttttcacttaggttgaataggaatcagagcatgagtggttagttgttgccaattatgcttaaaggagccatagccatttaaggccacatggtatgcctagacaggaaaatctggcgcctttcttgaaatggttagttaacattgatattttatatctgtaaaaaatgcagtacctgacaggcatggctgtcagtcaaatatgtaaagagtgaagaggaagaatattgttttaccatttttatttagtcaccatggttcttcctgcaaacctccatttatttatgggacatgagagctggaaaggaccttagaggctgtctggttttcatttttccagagtggcttggaaaattcattgacttctacctaggtgtcactgctggttagaggtaaatccaaaacaagcactcagacctcccaactcctagtcaaatatttttcaaccactttacataatatttgtcttctcttatgtgggaattatggttttatcccatagttcataatattcataatttttcttttagtagataaaggcaaatggacttaattcatttcttacacagaacagccattattctgaaacagtcttgctttttatttattttgagtgaatttaatgtttccattgtgtctctggaaacaggctgtgtttttgttttggtaattttgtttgtacattttttaaggtattgagaagtaggactttgttttaaattatttcttattgctgttggttttgctgatttactatttatagaagctccaatgcactgccttgaaaagggctgctgtgctgatccatgtcatatcctttattccagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagtaagtgtgtactcctttttatggctgagagagggccataggtgcagcttctatttatcctgtgccagaacttacaaacctaaagatgtttaaggcatgggagaggatcttgttaaaaatagtttggagcagaaaggtgtgagttactaaacagtaaaaaagggaaatgagatgaaaaatctgttctttctatttctattccccactggctcataccggtgtttgtgaattctagaaaacactaaaacatgaacagataggctgtttttgcttttataccagactttcggggagctacctgccaccatactgctctctgcccattggtcttttttctggagacagagtctcactctgtcgcccaggctggagtgcaatggtgcaatctcggcttactgcaacctccacctctcgggttcaagcgattctcctgcttcagcctcccaagtacctgggattacaagcatgtcccaccacacctggctaatttttgtatttttagtagagatggggttttgccatgttggccaggctggtctccaactcctggcctcaaatgatctgcctgcctcggcctcccaaagtgctgggattatgggtgtgaaccaccatgcctgcctatcttgaacttttataaaaaagaatccactgtccccagacagtgtggtggcttttttttttttttttttccttcagacagagtcttgatctgttgtccaggctggagtgcagcggcatgatccttttttttttttttggtagagacagggtttcgccacattgcccaggctggtctcaaactcctagactcaagtgatccacccacctcggcttcccaaagtgccgagattataggcatgagccaccatacccagccatttttaaaattttctgtagagacaaggtctcactgttttgcccaggctggtcttgaactcctcctgggtacaagtaatttccccaactgccgaagtgctgtgattaaaagcatgaaccaccatgcctggcctcggtgtgttttaatgcagttgatactaaagtaaaacaggaaaacaagaacaaaaatttatttgttttgaaggtgaacagagggctaattttctatgcttttctctttttggaaccctgatgaatgttctctcttggtacaccttcctttaaggaagttggaaggtctagaggtaacagtggggaagttaacctagttaatccaactattgtggaccaggcagagataatctcaacctcagcactatgggcagtttgggcaagataagtcttctttgtgggaggttgtcctgcacattgtaggatgtttaagagcatccctgacgtctacccactagatgccagtaccagtctcttcccacctccccagccccatgacaaccaaaaatatctcaagacattgccattatatgccccatctttaacatagagactgaagtatatgaagaaaatctggcattctaggtagttagaaaaggggtgacctcaggatcagacccccctgaaagggtttcatggaaccccgagtcctcagaatagactttgaggagaactggcctagagattagcaatttggaaataaagaaaatcacttttgctacaagtggtatcaactggggttctgttatatgtattcctattgtattagattgaaatgttaagtaattatattcttctaaattctgcctagtaaacaggaatctggggttttgtaaagcacgttagttcagatttgaaatttaagataacgtgactatcctggacagaggtgtgccagagcagatactgcattagcatattactggtgttaacagtattcacctttcttaatgggaagcctaccggatattttcttaagttgcctttataaagcaacttaatgtgatcagttcttccgaatggtgatcagttattttaaatattttctttttttttttttttcttttttctttttttccttgagacagtctcactctatcgcccaggctggagtgcagtggtgcaatcttggcttactgcaacctccacctcttgggttcaagcgattctcctgcttcagcctcccaagtacctgggattacaagcatgtcccactacacgtggctgatttttatatttttagtagagatggggtttcgccacgttggccaggctggtctccaactgctggcctcaaatgatctccctgccttggcctcccaaagtgttgggattacaggcgtgagccactgcgcccagacatattttaaatattttcttgctatttattaaaccatttaaaagttatccagcttacttctcctttgctctaccctaatatgcagtattgttgtgctttgtagataaccaaaagcaccattttgtttcagtgagccaatttgattttcttccctaagttgaattaacaaggttttactgtagtgtgatagccaaggcaattaacaaaaaattatgaggaagtcatttttaaattctgtacttttgtttgattctatgattttactttatttttttttttaaataggaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgtgccctggtctaagttactcaaaggccatatcttcaccaggccagagattcagttttaaacctcagcagccatcagtttggccaagtggttggtaccagtggaatgaagtctttgatgggtaggagagagagggaaaacctcaaactacatcatagaagtatgttaaaaccactttaaattgttgacacaaagtggtaaggaagttttgtctgactcagcctgacaagcctggatagaaatggacctcagaatacagaatggagtccttgagtgtcagttggtgaggaccatggagtcctgccagctcaacctgtcatttacagactaagaaagggaagtacacacctggcttgtggccagtctcctgccccctctctgggctttcctcactgttctctcccttgaatctcatttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacacatttcttgtcttggtgggtttcattttcttttagaaatcaatgagcaatatagggttcttttaagaaccttctgtgcttaagcctaaatagctaactaaatggattcctttttaatttggtgtttataatcattaggaagtatacctcagcttttaaaaggtgtgacattcaaaactgaaggacgaacttcagtttttaaaaggtatgaagttcaaaactgaattacatctgaggccattttacttggtctgagaaggagggcttagtttgggtctgagaaccatgcaacagttaaactgaatccctagacatatcctattgtcattttagtttaccagattccttctgcctggaatgctatgccacacacacctctgactcccagctgacatttggctagaaatcctgacctcctgcttccattctccacttctgcttcagcagtgctcacatttacctgtggtcttggctcctctgctagactgtataaacttctaggtaggcagtggccatattcctttttaattcgctgtagtgtctctaatgggtgctcaatatatttggattgaattaaattacgtgttaagtctagaaatcctctgctacttaattctgcaatgtgcttgttccctcagatggtaataggagttagacttgaaccatctcagtggggaagtggtggtgtccatcactgaagggagttttatcttcagttaactattgccactgtaatgttctgtaacaaaccatcccaaaactcaatgactaataagcatttattttgctcacaagtctgagttggctttagactggccttagctggacagttctggtcttgattggctccctcataggcctggcagttgactgaggttcagctgatctaggatggctttggccagcagagtgggggcaacagctctgctccatgtcatctccaccagcctagcctgggcatgttgtcatggcaaaggcagagaggtgtaagagtaagagaggaaccaaaatacttctgtcacaattgctaagacatcattggccaaaccaagttagagagctaagttcagaatgaaggggtggggaaatccattccccaaaattgatgggaggagttgaaaaagagattggaaagggtgtagatacagggaggtgggaagaattgtggctattaatgccatctattacattcacatgccctgtgactgccatgtttgagaccactgggccacatgatcgctaagtcccctcccaattctggcattgttcctggccagataaacgaaagttccagtaagagttaagatatttctattcatgattcatgcagagggcaccaaaagccacccaatggcttctcttggcttggccctccctccttcattcactgtgtatagtttgctcccctcctgccatttcttaccaagagcactattccagttatctgttgctaagtaacaagctacttcccagaacttggtggtttaaaacaatcactattttacatcatggaatttgttggttacaaattgggacagagcttggctaggcaggtcagcttcttgtggctttaactgtggtacttagctggcagatgggctggactgcagggtccaagctagcttcactcacatgcctggcatcctggtggaggtggctggaagcaggctcctggaacctctgggcccatggattgtaatggtgaattgctcaaatgtaacaatctccttggtgaattgccaaggtccttgacctgtaagctgattatcatcacacaagtgctgaagaactgcattgaaaatttaaattggctcactctactgtgggggaaggatggggccgaacaattccagtaaagcaggcattggggaataggtcggcccattaattgtaatgagctttggagattatttagcaatttgacccacacataccctccatgcccctagcggagcgatggcctatgtgtctgtcccaggagacactcagaaattgtcccatccgcttccccagcactggttcctaagtgaagtgctggtgaccaagctgccatcaaaaaccttactttgcttccaaatctgttactaaaacggctttgcaggtggacagataagaggtctagggccaaaccccaaccctacacttccctggtcatggtaggagttccgggacggcctagagaatcccagagacaggctggatccttgggggtcagttgagcacagcttgagcttctgttactggtgaaagcatcagaaccagtccagtactgaaagagtaaaaaaatcagtctgggtagagagagtaagtcagctctgtgcccctaccatgcctcagactgtcatagccgacaccagaaagccagttgcaacgttaacaggagaaatatttctcccacactgctgcaattgaaaagtgtcataaccattccttttttttttttttccttcagagggagtcttgctctgttgcccaggctggagtgcaatgcatgatgctcactacaatctctgcctcgcaggttcaaaagattctcctgcctcagcctcccaagtagctgggattacaggtgcctgccaccatgcccagccacgttttttgtatttttagtagagatgaggtttcaccatgttggccaggctagtctcaaactcctgacctcaggtgatccacccaccttggcctcccaaagtgctgggattacaggcaagagccactgcatccggccaaccattccttattttgagtgactactgctttctttccaatgacatctctagccttgctttgttactcccgccacctgaaaaaaatcactgtgaaactttgtgaatacccctagatccccaaagaggtgattgatttggcctgagccactaaataatgataacaacaaataaaatccaacacttccaaaacattttttttttttttttttttttggagacagtctcactctgtcacccaggctggagtgcagtggcacgatctcagctcactgcaacttctgactcccaggttcaaacgattctcatgcttcagcctccccagtagctgggattataggtgtgcaccactacacctggctaatttttgtagttttagcagagttgggtgtttcaccatattggccaggctgatcttgaactcctgacctcaggtgatctgcccaccgtggcctctcaaagtgctgggattacaggcgtgagccaccacacccggccttaaaccatgttatcactaaaattcaccacaaccttgaaataaggtactattattccccatttagaggtaagaaaacagagactcagagaagtgaagtaaattaagcgggttaattaaacagcgagtttgtggcagagccaggcttcaaatccagatgtgtgaatccaatcttctgcttttttcacaaactacaccacatctttcttgacctatggcactctgtgagaagtcagtctctgtgagtggacctgtcaaaatcaaccaggcctgcaatcccagtacttcagggtgtggaggtgggaagatcgcttgaggccaagagtttgagaccaccctggacaacatagtgagactcaatctctaccaaaaaaaaaaaaattaaaagactcgaacagcaggccgggcacggtggctcacatctgtctataatcccagcactttgggaggccaaggcaggcagatcacttgaggtcaggagttcgagaccagcccagccaacatgatgaaaccccatctctactaaaagtacaggccgggtgcggtgactcacacctgtaatcccagcactttgggaggccgaggcaggcggatcacgaggtcaggagattgagaccatcctggctaacatggtgaaaccccgtctctactaaaaatacaaaaaattagccaggtgtggtggcgggcgcctgtagtcccagctactcaggaggctgaggcaggagaatggtgtgaacccgggaggtggagcttgcagtgagctgagatcacaccactgcactccagcctgggcagcagagtgagacactgtctcaaaaaaaaaaaaaaatacaaaaattagccagacatggtggcttgtacctataatcccacctactcaggaggctgaggcaggagaatcacttgaacccgggaggcagaggttgcagtgagctaagattgtgccactgcactccagcctgggcaacagagcgagactccatctcaaaaaaaaaaaaaaaaaaaaaagaatcaaccagtagctttctgggtatggtgtgagcagtcttcccaaaggtttgcctcaagcaactcagcacctattcctgccaaaaggagaagcaaaaccagataaccagtggaatggacattatgtgtgccctgtacccattcccccaattcatgctccccaatatttggtccagaagtcacccccatgtagcctctgtgcttctgcagaatctccaggggataggctaagaataacgtgtctaacagtgctaagctaagcccatggcctgggtcagcaacattctagaagaggaagagcattgtagccgattgtttggctggatggtagtgatggggaacagttcccaggttgggcatgcagaaggttttccggtactttggattaagacaggatgcagtggtcctaaattcttataacctttgtctccatgggttcaggaacccagccttcattcgtcagcaagtgccattctcctgaccaatagaaattggttcagtaacaggcgtgtgacccaaagcagaccaaggaggctcactgcctccttggtttgctggggatttccagaaaataaattttctttcttttttttcttttttttttttttttttgagaaagggtctcaccctgtcacccaggctggagtcctgtggtgtgattatggctcactgcagcctgaacctgctgggcccaagcgatcctcctgcctcggcctcccaagtagctgagagtgaaggtgtacgccactccacccagctgatttttgtattttttatagagatggggtttcgccatgttatacaggctgatctcgaactcctgagctcaagcaattcacccaccttagcctaccaaagtgctgggattacaggcatgagccaccatgcctggctggaaaagaatttcttgagagccactggaacaggcattgtctcttcctctggattctgcagggtgcagatgtaagcttgaaactgcagcagtcaacaccctaaggatccaccctaaggatcaaattaatggaaaggttcaaatagttgagaggatagtagaggaatagagtggggaccttgactgaatcatgcctgatcaccccaccccagtggacttttaaagttatatgaaccaataaatatgtggtattcagactggattttctgttcttgccaacaaaagcatatggactggcatagccttctttggtgaccaactgcatctctgagaccctgtcttattctaagccaccccatgtgacagcctcaggagcagctaagggaatccgttcctgttcctagggtatgttgtcagaggtgaagggcaggcgccacacccacaatctgttagagctgcaagaaaaatcagcccttattgaaagtctttttcaggtgaggaaattgagaccatgagaagtgatgaacccagtctgaatccaggtacctgcaccccctgttcagtgttcttccctccacattcattgtagcaccccaacttcctccaggaccagcagattatctcaggaaacatctacttggcatagatgagctcttggataccaattatgtggctccctgggcagcacagccacttttcttcatggggaaccagctccctacatcacagttaggatttcaggaagggctgggagctgcccaccttccccgatctctcatctttcaatttcaaaatgccaaagggccagaattactactattacacatattcttaaaacatgtgactttgaatcctttcatgtcctgagcctttcagaaccgtcccttgaaatagctccagataggcccatccctaatatttcggggaccaggaaagagcatatatggacactcacataccaaatgtttaggtatttacattataatcaaagaacagactatttttgttgttttgctttttgttttttagaggtggcgggcggggagggcggtctcactgtgttgcccaggctggccttgagttcctggactcaagtgatcctctctccacagcctcccaagtagctgggactacaggcacatgccacctgatctggtttggctgtgtccccactcaaatctcatcttgaattcccacatgttgtgggagggacccagtgggaggtaactgaatcatgggggcaagtctttcccgtgccgttcttgtgatagtgaataagtctcatgagatctgacggttttaaaaggaggagttcccctgcaaaagctctttctcattctctctctttccctgctgccatccacgtaagatgtgacttctgccatgattgtgaggcttccccagccacgtggaactgtaagtccaattaaacctctttcttttgtaaattgcccggtctcaagtacgtctttgtcagcagcatgaaaatggataaatacaaattcctggacttaagtgatctctcaccacagcttcccaaatagctgggactataggcacatgccaccactcccaattaaatgattcaatatgttctatctgcttccctcaaaaaggatactttcataaagaatggaaggccaggtttgaatttggaattttagattccacaaagtcctgtggtagcaagaggagaggagggtccagccccttgccagatccccttctgtttttacccctggcccatcccacactaagaagggcttcatgtgtgtccatgaggaaatcccagcccacattccaagccccatctataattcctacaaacaactttttgctggccacccccaggcctgcatgtgtttcaggtcacactcaggaggacagacatgggcaagaggcctgcaggtctaggaagcaggctcaagaccacttgggtggggaactgtggtttcccaggtacctggagcatggtctaggagtggggcttgcaagctccagcgggtatgttactttggccacatagagacctcaccctgtggggagggtaatggccagaggagggccagggtagggccctccagccttgggacccaggacagggcctctcttggccagatccaggagtagtactagacctccattccatcctaaacaaggtcctaaaactagggctgaggacagggctggcctagcaagactgggttttttgaccttgggcaagtccatgacatctctggatctgtttcctcccttgtgcctgagggaactggaatgcttccacattgtagaaccctccacagagtttgggaagcagatttgaatttagactcctccctccatctggcaatgctgagacaccggccccacccccaccaccaacggaagagagagccacagtggggaaatgaactgcctttatttttttatttcccatccagaaaccccagtgtgatggtggaagcagcatgaaaacaacatctccccaggcctcgcagtagaggcgaagggaacagggctgcccatgtgcctgtctctaaagacgccaccctcaggttgatgtcacctgtgggagaccgggtccacctacagacaccaggtgatggtccaccaggccccaagctccagcctgctgagtccccaagacacaggctcattaaatagcttcgtacaaaaacccaagggtgtccctccagctggtaaaaattgggcaatttctacttgaggtctgctgtgggggtggacctcaccttggagatgtctttccagaataaaactaagccctactcaggaaaaatggtgatgaaaggcagctcacagacatgcacgactaataatcttattgaaaagggaggagctcaggcacacaggaggacaaggctatgcaatatgcagacatgaaagaaatgccacgggacgctgtcaggggtcagcaggaggcaaagaggtagagctctggccaggaacgctctgcctagagagagccctctgcagctggccctagatcggggactcaggggagtatctgcctaaggaccaaggagacaccaacagcctgcccaggtgtgggcttgtgcaggtcacacagtcctcatgagtctcctggacaggaaatggacatgagggacatttttgagacagggggcaaagtgcagagagagccaagaggtcaagatggtgccagagattttgaaaccacaagagccgcccctttgggaaacactgagaagaggagcctcttctctagcctctgcttggggcaagcctgggtcaggtgggttctcagtactttttcacagttaagtcttttcctgggcagccacatccacgtcaggctgggctgggctgtggccagtcgaggggtcctttggcaggttcaaagctgtgagccaccccgagagaacgtgcccacttccctgctttgtggttcataggcctagagagacccgacagcgggctgcccagtgtgagtgagaatgcctgcacgtttcggtggtcaggggcggagaggcctgtactccagattccccaaagagatcaaaacattctaaaacagcctgcaggtctgtgtgtgtctaacagtgctcagccaagtccacggcctgggtcagcaacattccagaagaggaagagcattgtagccggttgtttggccaaatggtagcgatggggaacaggtctcaggttgggcatgtggaaggttttccagtaccttggattaagacaggatgcagtggtcctaaattcttccagtcagactgagttaacagcatgtcttagtagcaggaatttgtccttgtttttgtcacacaaaggttggtggagacggggccaggacatggccagtttgatgacagtggagaagctgctgccagttctgtggggcgcagcccaccttctcctcacggccctcaggtgaagtagcggcagggcgtggagtcgatgtagcagtactgggtgcattgcaggtctccatatgacctgagggaggcaaagacacgttctaaaaggccacctcttatatgctggtgacttccggtcaaaccttatcaaacagcggccaagggccaatggctctacaagaactttttcccattctcatttggagtgagaggcctgggggagttgaatcatgtctctgggatttttgccttgaggtctagctcggggcctgggtggaaggaggtggttgccctgctcttagcacagcatctgtgagggaatcccccttgctacgatgcagcctaccaacaaaaatgtcctgtatctgtgaagccactggccagatgtggctattgagctcttgaaatgtagttactgtgactgaataactgcattttttttttttttttgagacagagtttcgctctgtcccccaggctggagtgcagtggtgtgatctcggctcactgcagcctctgcctcccaggttcaagcgattgtcctgcctcagcttcctgagtacctgggattacaggcacgtgccaccaagctcagctaatttttgtatttttagtagaggtgggatttcaccatgttggccagggtggtgccgaactctgaacctcaggtgacctgcccgccttggcctcccaaagttctggaattacaggcgtgagtcacagtgcctggcctgagtaactgcattttaagtttacttataatgactttacatttgaacagcagcctgtgaatgggggctaccatattggacagtgcagtttatacctctgtaggcccggatgatcatccgagacagggcgttaaaccttacaggcacagtcacaggcgtccctctgaggcttctggggaatagctgtgtaaccacagtgagcgtgggggagccctgggctctactcgatcctgtactccatatctgatcgtctacattgatttgtctctgtggagccatgaagagccaactctctggcagaggcctgtcaggggtcttccttccttcagggagaggggcactgcacacagacacatacatggagtggggtcctggccaagcctaaatgggcttagagtctgggggagactgggggagactacaggtctgtagttctcccagcctggttgaacatgctaatatctgagtgttagggagacccccttggaagagagagcacagagaaggcaatggagagacaggcatggctccccagccctgccaagggcccaggtccgagtctacaagagaaaatgggatgggagcaaaagctgaagggactggactcaaggacagaagagatcggaagcaccagtagatccactctggaacccagtgaagagcagggcatggcctaggtaaaaaggaacggcctccccattttcctgagaacgttgtacaactctggttctgtaaggactggggagacatgtaccttctgcaccttggaaggagcccagtggttacaatctgggcatggaatcagcacctcatggggcggtggccctcagttggcttggcaggcgccagtgtggagccaggacactagaatacttgtcctgaacaacataaatagccactgaggactctcagaaataactagaggggtccttggagggagtattttcttggaggggccatgagcttgcaaaattagatattaaggctgatttgatctcacttgcagtcacaggcatgcctgagggatgggcagggtgttccagggaagtcaggttaggtagacatgtcgattcttggaaatgccctgagacctttactctccactgggcttcccacctaggcccacagcccaggagactatgtagtcatggtgaccactgggtttgggggctgctcatgcagggcagcagctgagctcagagaccgcagctcccctctgggccttggatggagcaggtggctgtgggtgccgtggctcagtctcagtggcacgcaggcagtgctgaccaagagggcacgtggtaggcagggagcacgtgttgtgtcattcatcaccatacctcagtgtctagaaggcaccacaaagtggagaggcactcaaaatatttgtgaaggaaagaaggaaagcaaagaggagggagggagaaagaagggggagagggagggaggggagtcatccctacccagggagataggtctcgcatgtcaggtagccaaagtcagagccgtcacagtcctccacaccctcatgccggtgaccatctccacagtaggcacggtgacagcctgaggggacataaggaggtgcagtcttgagaaggagcagaggcgataggcttgcctcagcttgtaaggaccatgcggcccaagggatccaacctaagtgctgcaccccttaaagaactgacctccattaagcttcacactcctccagggactgcccacaggctctggtcccacagcgatgtgccatgggacaagaagaaggagatcctggctccagccccgcctcacaacttactagctgaggggtggggagactccaggttgttatctgcaaaactgggacactgacatgacctccacctcataaagccagtgtgggggtcccgggagtgagggttggaagactgctgagccccagtgagggtgcatggtgactctcatctgtcaacagagagcttctgtgtgacactggtgagcccagccttgtgtccctggggagccacatgatcttcagcaaagacctctgctctcacacgatgggagggtgttggagtatggatcccagcgttgttttcacagggcagggacagtccattagttccttcctactgtgagagctcctatttgacactgtgcaccagaggcagaagggactctgggcagggccagccttctaggggatgccatccctggagctgtcgggagacagttcggccacactgagacagtcagcagcatctcccgccacccactctgccctgtcatccttcccctgaactgttttttttttttttttttttttgagacagggtctcgctctgtttcccagcctggagtgcagtggtgcaatcgcagttcactgcagccttgaacccctgggctcaaatcatcctcccacctcaccctcctaagcagctgggactacaagtgcgcaccaccaggcctggctaatttttttaatttttatttttttttgtagagattgggtcttgctctgttgcccaggctggtcttgaactcctgggctcaagtgatcctccaacctcagcttcccaaagtgttgagattacaggcatgagccactgtgcccagcctcccctgagcttcttgagagcaaggaccatgactttgcatccacacatccagccctgagccccagcctggatctttagagcaggggcttaaaccacaagccctaaatgaattcagtgaatggtggttgaacccttactatatccagataatctctgcacatgttagctcacaggatctctagggacttgagcagccagcacatcatacccattttacaggcaaggaaagtgaggctcagagctgtaaattgccccccattaccccacccaccatgtggcctctgccttgagcctgagggtggttggtgtttctcagggcctgcattcaacctctgttgactctaaagctcctgctttccatcacacctcctggttttgttacttgattaaaaacaaaaacaaaaacaaacaaaagcaagccctccagagcctgctgcctaccagttaaggcagcagcccacgaggctgacagcagctctggctggcccagtttcccctacggagggctttgctactagagctctacctggtaaatgagccctcattcagattcttggcctctcccttttgcctttcactactccatgcaaagtgagagcccatcacctttatcttctgcacctgtaacatgggttttgctaagatgtaggactgggaggacctggtggctacattttgagataaagaaggcctaactgggggcaggatccttgacatccgcccctggtgaggtgcttgggtggtggaagagttaatatttgggctgaaactggggcagcagggactggggtgggtggcacaaggtggcctgggtatacccttctctggctctagaaaggtcccaaagcaccacagctggtgtccagggctggccctgagtcccacccccctgctgttcaggcctcaggtcctcctggtctgggcctcactcacggatgcagtcgtcacccacatcgctgttaccgtcgtcacactcctccccaggctgcaggagcccatccccacaggtgccgtgctggtctgcagtgtaatccacagggtagaaaggggtcagctggccaaagaagcacacagcattaactggagcatggcatacccaggcagccgcaggcagggaggtcattggttttggtccaaaggcactgctggggggcatgccttgacttcctcccaggggtgggaaaggtactcctttcctgttgcccagagctctgtagctggttaaatgttgggtcagatcaagacagcaacctggcacgcagggatgtggagaccatctggaaccctggctcagagaggggcttctatttgggagtcagggtgggggaatggagggctgctcagagagagtttgagggaggatgctcagccctcccatgcagacagactgtagaaagccctccccaggcccagtggggtggccttcccttcctttaatggatgcatctctctcctgggcagggagtatgtcctgaggtaatggcctgggggtacctggatggggagccagccaaggctgtccttgaagtacagagatctctggtctctgcggaaggcaatggcgttttgggtgttcagcctctcaagctcctcctggttgttgaccacaaaaatctgccagagaacacactggtgaggattccagaaaacacttctgcagggggcaggaaaaaagctggaggaggaaacagaatctctatccttgggctgctcaacagtgggaagaggggtttgcacactacactctagcattccttctgaagtgagaggagtgtcttgattccctcatcttctcaatcgagttcctaatgtctgagtttgaaactaaaatattcactcggatttaacttttttttctttttttcttttgtttttgagatggagtctcacgcggttgcccaggctggagtgaagtagcgtgatctcggctcattgcaacctctgcctcccgggttcaagcaattctcctgcctcagcctctcgagtaggtgggattacaggtgtgcaccacaatgcctggctaacttttgtatttttagtagagatagggtttcgccatgttggccaggctggttgcgagctcctgacctcaaggtgatccacccacctcggcctcccaaagttctgggattacaggcatgagccaccgcgcccggcctcggatttaacatttttaaatatttaaaacgttcccaagacttaagttaaaaggcaatgtcatatagtcaagtaatttgacatctggaagtgattcttaaaattatcctactcaaagatattctttacagcattatttacattagtaaaaagcttgggggtggccaataagcaataggttggttaaacaccaacactggttaagtaaattgtagcacagccacactagatggatgattatgatgaacagatgtccaaggtttacttcaaaataatacaacagagaatgggcaggagtgagtaggcataaagagaaaacaaggacacaggctcgccatgagttgatcattattaaagttgggtgaagggtacacaggggttcattacactatttgttctgcttttatatgtatttgaaattttccctaataaaaagtttaaaatgttatttatagagtgtggaaacatggcaggatttcaactaagataacaaagtataactttttttgagacggagtctcgctctgttgcccaggctggagtgcagtggtgctatctcagctcactgcaatctccgcctcctgggttcaagcgattctcccacctcagcctcccaagtagctgagacaacaggcgtgcaccaccgcgcccggctaattttttaaatatattttttagtagagatggggtttcactgtatcggccaggctgatctcgaactcctgaccttataatccacccaccttggcctcccaaagtgctgggattacaggcataagccaccatgcccggccaaaagtacatttttatacaatataatctcaaccatataaaagttagattttaataagacaaagaaaataccccaaaatggactcacaatcaaatggacaatttggttttcctcttgattttctcatattttccaatttcctataatgagggtgtactcagagtcgtgaaaaaaagttagttttactgaaaggattttacaaagccccataaggatcaggtgagaggtcctcacggataaccaccccagacttctcccagaaagccttaccacaggaactcgcggggaactgggcccatacacagattccccgtaggaagggttattcacattcatagtgggtccacaaagacatcttcctggaggcccgggaaatcctctttcccctttgggtcccattataagttgtcctaggaagcaacagactgctgtgttactagagccaaggaagagaagaccaaacaaccagggagatgtgagcgacctttgcaacagaaaaaaggttaaagtccacagcatttcagggtatgcctgagggagaggttcaaagagatgcttttgatccaagacatggaggagctaaggtaagaaaaatagctggtaggcgatagtttccccctccttcctgccttgaagacaggcaagatgtctggtgttgcagcagccgtgttgcaaccaggaagtcacaagcatgagaagataagccaacatgcaggaaagacgaaaggctcatggggcctggggccctgacagtgacagtcagaggctgaatcaaagccagctactgcctgcctctggatttctttattggagaaaaacaatgtcttatttgtttagaccattattaacagagggcttcttgccgacaaacacattattgactgttaacttttattgttttaaaaaacttttgtttttcttatatatagaatttttttttttttttgagatggagtcttgctctgttgcccaggctggagtgcagtggcacgatcttggctcactacaacctttgcctcccaggttcaagtgagtctcctgcctcagcctcctgtgtagctgggattacgggtgtgtgccaccacaccaggctaatttttgtatttttagtagagacggggttttgccatgttggccaggctggtctcgatctcctgacctcaagtaatccgcccacctcagcctcccaaagtgctgggattacaggcgtgagccaccatacccagccaatgtaggatctttacagaggaatttctggatgtgggtttctttcatttcttctggaagaaaatagaacattagtatatgctctgcccatttaccctcccctggtgctgaagaagtgaggacatgtcttgaaaagatatgatcagaaagtgtactccctagcaatgtggaagaactgtgagggtagtaccttggtttttaaaggctctgatacccaggatacacctcagaccaattccatcaagacttctgaaaactgaactgaacctaggcagcatccacacttttatttatttattaaaaaaaatttttttaccactttagcataaggcatcctttttttttttttttttggagacggagcctcactctgtcgcccagggtgaagtgcagtggtgtaatctcagctcactgcaacctccgcctctcaggttcaagtgattctcctgcctcaacctcctgagtagctgggactacaggcacgtgccatcaggtttggctaatttttgtgtttttagtagagacagggtttcactctgttggccaggctggtctcgaactcctgacctcaagtgatccatctcccttggcctcccaaagtgctgggattacaggtgtgagctgccgcgcctggtcaggcacccatattttattattattattattattatactttaagttttagggtacatgtgcacaatgtgcaggttagttacatatgtatacatgtgctaggcatccatatttttaaaagctctcaagatgattccaatttgccccaaggttgagaactgggccattcccctgccagatcatcctcccttcatcctccatccctccccagctgcctctcaactcccttctgatctgggttcaaacatcacttcttgaaggaagactttttgaatcctcagactctgtcatgtatacctgggatacaatttcatggtttcctatgcctttcttcacagcacttctctttgtgattctatatattgtgagattattccatcaaggttgatctccagtagaatgtcgctccacaaggacagggctagtgcctgttttcatccaccagggcttacacaaagtaggggcatggaaagtgtttgatgatcgaatgaatgaatgccgactaattggagagaaaaagtcttcagaagagggtaaaagtcacattctggctggcagaaaagcaccagaacaaaagccatctaacaggaagtgaggaaagagaaaaaaagatggggactgagaagagaaataggtaaggatcccttcttctgggaaaatagcgaggggtgggtttggaggccagccagtcattggtgtcaggcagtatgacatctggggcagccaggggctgggaacacagttcacagatccagaagggcaggaaataaaatgaccccaggggagagatctggccaggaccccagggaaaacactgcagtcggaggagactgaactttcctgagcgagttgacaggtattcgtacaatcagaatgctgacagcatgaggggaagggcactgtgccaatatcttatcctaagttatggttgtttgttctaacaagaaatacaaatataattctgtaggaagagctccagtctgtgttctgatattttcagaagagcccagagagacagggaatccaccaggctaggaatattctgggtaattaagcacttggggaaattgaagtggaaaagctctgtgaccaagaatatgagggtggcattggaacagccttccagaaggctctgtgaccccaacaactcctccagaaccatggcctgagagacagtcaggagtttgtcccattagctgctgatgaatggtgaggctgagatttgaattcatgttttacttaacactatgctgttcaaaagacaaatgtccaagaatactgatgctctcaggaagctggcaattcccaggtaccacgttgattcacttatactctgtctgggtacaggaaggactcagccaaatttgtaatttgattattgcaaattacatcctaaaggcattttgcctttattccccccccgacctcttagcccctcttaccctctaactcagataagtacaaagctctcaccctttccacctcccccagcaccatctggtcccacagagctgggcaccagaaaccgaggtcacctcccaacaggatgtggcagggagcctgctgccaccactgcagtttccctgcagcttcctcccagttgctgcagggcatctgttacccctgcctgttttctgccaggctatactaaaggactcagcaacctgaacttccccaccctgacctctgggagatcatgtctcagctgggtttcatcgccaccccctgcagccagaggacctggctctccatcttttcccaggcaggctcccgcttccattggctgcctcagtgggaaaggatcaggaaaggggaatctaggagagggcagaggaaccagcacaacaacctctagggccgcctggctgacactcacccattctggaccagggtggcccccagtcactgctgtgaccttgcaggcatcacttctctttgaggttcaagattcttttctctaaggggagggtaggactagaccaggggagttttaacctgtggtctacagaggccaaggctatctcacgatggcgctgggacaggggttctggaaccctgggaaacagggtgcaaaaccttggatgtaggtatatacagttttttcccccccgagaatgggtttgggactttcatcagactgtcaaaggtagtgtcaggaaccaatttggggggcctagtccaactctggatgattatccaactggtcccaggcacagggataacttatttatttatttatttatttatttatttatttatttatttatttttgagatggagtcttactctgtcgcccaggcgggagtgcagtagcgagatctcggctcactgtaacctccgcctcccgggttcaagtgattctcctgtctcagcctcctgagtagctgggattacaggtgcccgctaccatgcccggctaatttttgtatttttagtagagatgggggtttcaccatgttggccaggctggtctcaaacttctgacctcaagtgatccgtccacctcagcctccccaagtgctaggattacaggcgtaagccaccgcgcccggctgaatatctctttttaactccttccttgccctctctccccacccctccaatattttccaaagagcaggattatttattgccccatcttctctttaccttcttcagcccgctcactcaggaagcctcctcagaaaggaagtggctcaaaggacggaatggggggcgggggcatcaatccaaagagatggtcccaccctgcttggctcctaaggagatgaactgtgaacccacagaacccctgcctgggagcccctgcaggaagcagccctgtccacccacataccaggtgccactggggatgtgaagctgactcagccgcctacctcgccctcaaggatctagtgggaagatgaaacacatctgcagaaacgttaccaatggagaggccataacagagaggcaatgaccagggctcaggggagggtgatccatcctgttaggggccaaggaaggccttactgaaaagagagcttcaaaggaacagagaattttgttggatggacagaaggtgagaggagtgccatgtaaggtcatgtggacccagagagaccataggaatagctccagctccacagacggcaaggtgtcctctgaagggtagagggcagggcgtgattgggcagaggctggggtagtcaagggagagggaggtgggcatactgggtggaagagagggagctggaaggccagggagaaaaagtatgactctgcggggcctgctaagaggacaggattgcaatacaccgaagacagacaagacaagagaaacagcaggcaccaagaagctgctgacagctccagcctagcccttctcatccatcccctagccccaggagggaaccagacaagtcaggtgagggctggcctttacaaagagataaacacagtgagaccattaagatcccagtccgctaaggatctcctacacatcccacatccaccaatcccattgcccctggactactcctcagttttttttggttttggttttgtttttttttgttgtttttgttgttttttgttttttgttttttttgagatggagtcttgctctgtcacccaggctggagtgcagtgactcgatcttggcttactgcaagctccgcctcccgggttcatgccattctcctgcctcagcctcccatgtagctgggactacaggcgcccgccactacgcccggctaattttttgtatttttagtagagatggggtttcactgtgttagccaggatggtctcgatctcctgacctcatgatctgcccacctcggccttccaaagtgctgggattacaggtgtgagccaccgcgcctggcctactcctcagttttgtgagcccctaggtaccccaggggccaagagagtcccttctgaaggcacaactcaggccaagctctcagtctctgcggttggtagctcatagttatggggctccagggggacatcatgccttccagaaccaaggaggaagaggactagttgaaaggacccccattcagatcatccagccaattccagaaatgaattatggagtgtgggcacatggcctgggctgcatctcaaatctgattcccctaacaacatggaaacaggcgcagcaaacataagttattacccatactaatcagtgtttgttctcccagtatttccttcctcctctccctatttcaaggaggtagcaagagtttgtgctttcttgcccttgctaaaagcaggtactattggaaacaaacttttctttctgccttctgttctctgaaggacaaagctcctaattggggtgctggtatatgaggagtatgaggaaggaggggtcagggatggaagaggagagacctccctagacatggacaggagagggaccccttgtatcctgagaaagagacaggtctcagaaagaatggttgtggggtgctccttggaaagttgaactgtggggaccaggactcccagccttgaaaatgttctgatacccacgtatggcatgagaacagcagccaccaggtatctgtggaccacagggacttggacaacaagtctatttctatttctactctatttcagaggtgaatggagtagaccaaaggttggagggaccttccctgacatttttctgccataattcaccaggatctttgcccaacctatttgtggttgttggaggagtagtgaaaatcctaataatgcctgaattaatttatttggcatcctagtaggttggactctcagagccagatttaacttagtttaaaggatctaacaaaatatgacatttcttgcccatcccatgatgtggttgcaaatatagttccataaacacaggaggagggggaatacactgtggaattgtaaatgtcttcattttcttaagaaaaaagttggaataaaaattgtttggattccttttgtataactgaagacagaaaatgttgcagtcaacaaatgatcttcttgatactgtctttatacagttgatgtgctgtgaaagcccctaccatgagctgacaagggaacgaaataaagggcttagctaataaaattgaatgaggtaaaagaggaagcagcagctgggtgtggtggctcacgcctgtattcccagcactttgggaggccgaggtgggcggatcacgaggtccggagttccagaccagcctgaacaaaatggtgaaaccccatctctactaaaaatacaagaattagccaggcgtggtggaaggcacctgtaatcccatctactcaggaggctgaggcaggggaatcacttgaacccgggaggtggaggttgcagtgagccaagatcgcaccactgcactccaacctgggcgacagagcaaggctccgtcttgaaaacaacatacaaggaagcagtgtatctatgcccttctcaataacagactttatattttgatttatttatttatttatttatttatttatttatttatttatttattttgagatggagtctcgctctgtcacccaggctggagtgcagttgcgcgatctcgactcactgcaagctccgcctcccaggttcatgccgttctcctgcctcagcctcccaagtagctgggactataggcgcccgccaccacgcccggctaattttttgtatttttagtagagatggggtttcaccgtgttagccaggatggtctcaatctcctgatctcgtgatctgcccacctcggcctcccaaagtgctgggattacaggcgtgacccaccgcgcccagccaactttttatttttttattttattttagtaatttctttctacatcttttttttttttttttttttttggagacagagtttcgagatggcacaatttcagctcactgcaacctccgcctcccaggttcaagtgattcttctgcctcagcctcagagtagctgggattacagccgcgtgccaccatgccaggctaatttttgtatttttgtattttagcaaaaacagaacggtttttgccatggttgaccaggctggtttcaaactcctgacctcaagtgatctgcccgtctcggcctcccaaagtgctgaaataacaggcgtgagccacccatgcccagcctctttctctagctattgcaaacaaataaggactcttttataacactgtaaattggaaaaaacctgcaatgtcacctttacttctaggtttaagagaattgcttggagccatgacacttttatctagaaaaaggtattagttgatgaaatatgttcctgttatttttcacttaaggtataaatgacatcattaatgtgctttttttctgtcctctatttgttctccagaatgctaaaacaaattcagaatggcatttatctctcttgcataaaagttgaatgagctaaatcgtggagaaattacaaagatattggagtgtctctggtagtttctaacttgaaacacaaggcatctctgctggcatctccttgtgccctctctgggaggctggccagtactccaacagtggatcaagtgaagcagtgtagctcttacctgcaggtggggggcctgggggccccggacggccaggttgaccagaaggcccaggcttgcctggtgggcccataactccactatcccctttctgtccctgacagagagaaaggcagagcctgttatgaaagcatgacatagcaagcttcccgccccatttatcaccaaatcagagatcaccttgcacttaaggagcaagagcccagtgggggatgcagctccagaggtcttgaccatcgagctcttaataagcttagggcaagtgacatttgagatagtgatggctacaaatttgtagaccttagttcttgctctacaaatgtggcacatggcagctgaaaggaaccagtcaaatctactctaggccctgggcagatgaggaaatggaggcctagaaatgagctattttcactcattggcttcccgttgcactcaggataaagacttagctctttactgcagcctgcgaagccttgcatggctaggctttccagcttcattccagccttttggcctttttggtcttcaagggcaccatgtctattatcccccttctcaagacccttctctctgccccaaaatctcttccttccccctagcctagttaactgtcactcaccctttggctctcagctcaaatgccctatggcaaagccttccctgaccttcctggatggagtcagttcaccccaccataagctctcataactcagcctgtttccttcatggcatttatcccagatcatagcatatggattatttgtgtggtcatttcattgatgtctccccatgagacatacactccctatgggctggaatctgtctagctcacctcctttccccagatgaaatgagggaggacaaagatgctagaaacacaatggtaggcagctttgctgatctgtaaatccagaggtttcaccttgaccttgagactccaggtaactcatgtcattgctttgtacctcagttttgtcatctttaaaatgaggccagtaaatttacacccacataggtctgtgaaactaacaaagatctcagatgtgaaaatgtggtttgtacagaacgaagagctatgtggggcaagccaattatcacagcaactggcttggttccatctgtttcacgtagttaagtcttggtttattaaaaagggcacatctgtggctacagccgttccacatggagtgtcctcttttctgcctattctgggagtatcaagagcaaagactgggctctttgttctccctcagggttgctcttaggagtcaccccgaaaccaaggctggtgcatgctattgactcttcccctgagcaatttgctaattgtctgctcttgcctcaggcctaatcagagcagtgattgacacttgccatttttgacctggttcttcttactacacttgcgccttggcaggcttgcccacctgatgaaatgtaatcttcctcaaatctggggagcaggcaggcttgggactcctttccagccacaacggtgacaggtgaccggctgccttgtccacatggcactgggggccgtcttggtaatgtgcaaggagttcttgaactctgaatatgggatccgtgaggtcagagtttatttctgattccatgtttatggagggagttcttaagcctcagcctagctgaagcattccctgcagtaaccaagctgggtctcaggatggcaaaggaagtcacacatcttaatatagccacagttcagtcttgtttttctaacggccatgtcagctggctctgagcaaaggaagtgccaaagcttgaaggagctggaaatgctccttcattctgacaccagcagtaatggaatattccgcttatcggccatcgctcagaatgagccacgtctctatcagcaggactcactgagtagagctttccaggaaaggcattctttattccttatttgccacaaagttgggtgatctctctcaaggaaattgtttctcagttactgaagtttttttttttttttttttttttttttgagagacggagtcttgctctgtcgcccaggctggagtgcagtggcgtgatcttagctcactgcaacatctgcctcctgcgttcaagcaactcctgcctcagtttcccaagcagctgggactagaggtgtgtgccaccatgcccagctaatttttgtattttttagtagaggtgggatgtcactgtatgttggccaggctggtctcgaactcctgacctcaggtgatctgcctgccttggcctcccaaagtgctgggattataggcatgagtcgccactcccggctgagaagatttttataataaagtcaacagctgctttcctgggcttgcctgaaggcaagtcctgaagcatgaaggtagctgagagaagaagtcatgtggggaaagttggtctcaactcaactctctggattctaatcctggctttgaagctgacttcatggaggggtcttgggcaagcaactccacctccctggccctcagcttccttgagaataacctgaggagactggattaagtggtctctgtaatccttctggcacagaaattactatctgaaattccttctgaatttctgatttttggctttggattgacttaacaataactttcagagactctcagcactgctggccaacaaacaaagagtatgtaagactatgctgggagattaattcatgataaaaataaataccacatcaggcttctaaggctaacaattcgttatctcccaactggaacgaccccaacaccgagggtttgcagcaccctcgggttgttcacaatgtcttgtcgaaagcttgggctcttttctctaacttctctgagctcccagatgtggttttggtgtagcttttatgattccaacggaattagtctcagcaggctcaagaaatggccttcctggctttggttatcgccaggaactaggaaaaggcaaacactgcccaagacagaaggaagccaggaagcttctggaaccccaagcttaaaatattatgaatggaaatcattaggaggggataaagtgatataagaaaagatttctcccccatatttttccttttttatctgagcctacttttaagaaattggtatctgtggcatcattgtgaaaccatgaccatgctacccatgatcaaagtttgaaaactggactggatgattgtaacttcgaaagttactgcacagtctaaattttccaggttggagcctgtgttctttctaaattgattgggaaaagaccagaattggcttcatagtgttattatggttctgaaacctggctgcacattaaaatcatatggagcttaaaaaaaaataaccaaacccatgctgaaagctcattccaggtcaattatattatggtctttggaaaataaggcctaggcactggggatgaggagtggcaagcttggaactacaaccattgcacctgatgtgggggatctgtacatctgtatttaatcaccggccccacccccaggtgatcttgatgtaagattaagtttgtgggccacagatatagcctaaggaaataagtaaaagaatggaaaaagcttccatccaaagatgtttacctctcaggattatatatgagacagctaaggctgtctctagagcagtcatgtcacatcacatggcttaacacaagagcctgctgaccagggggagttcagaatgaacaactgccttaagcatgttaatcaacccaagaaaaaaggtcacttacaaattggaggcctgagtagggaaaaaccaccctattgttgagacccagaagacctctcaacagcaggaaaatatctaggctcatttttaaaacttcatttgtgtctgggacattgaagcataaaataggttttctgggtaaatgaccatatctgccttccattcctagctgctttggttaagacagacttatttttatgaaccaaatatccactcttgcttctggccttggcacagttcacatggagcatcctatcccatccacttcaaactacggctagcctagagatgccagcagcttctggaagtggtgctgctcccgtctgctagcccagaggatgctggagtcaaggtctacagaatatctctgattaacgccacctgcctgccactccacacactgccaggtcaggaagttctgacctcaggcgggtggtaagccctgggatccttacctgcttgcctcgttttcctggtcttcctgtgggtcctcggtgtcctgctatcccaggttcaccttttggacccatttcaccctggaaagaaggaaagagaagcaagagaggacttagggcatgtggagtgggcacatctacacaggtctagccagtcattggctacgagggcagtctacttgatcattccgaatctatgccaactgggctgccctgcaaggttagcagagtgaggaagtcatgagaaaggcagacatgtctttcatggaagaggagggaaggaagaaggtaattctgagtgggttatctgttacctgagagggacaggtgtggagcagcacacattttgatggccaaatagaagagacaaatcatcacccagaacaggcagtgagaggctggggcatccagcacagcatgcctgtgctaattactacaagctgtctgggaaaacgctttccttctagttggaattttatgttgtgttttcttacgtgctgtttttagcacaaattcaaatctggaggtttttaaatgattggacactgttttgccagctgtcatctttgggaagtttctactcatttaatgactcttgcttaggattatgtgcttgcccactcttagtaagcattggtttgagttccagctcacttccatttgatttagatgaaagttcttttgtgggagagatgttccaaacatatgttcacatcttcaatataattattgaaaaaggcatggagaacaatggaaacaatattcctgtttgtaaagctctatgttgaactatcaaaacccaatgtacccattgcagaatttcatagtttaaggccaatatttcacaaaactcatttctccatcttagtttctctccttcttccccattttcttctacatggattccagccccacttactatttctttgggtcagcccacagggcgcttcattcctatctccagtaatcccccaacagcccagaatgcacagccaacaagaaaaatttagcaatagcaaccatgagtgttaatcagcagccagtgcccatgaagagctgcccagacactcagagagaacaaaaaacacccaggcactttttcacatggcagtcagaggaggtataacacaatggaaaattccagggaacacctgtatatggaaaggatcaaacataaagctctgaaattatctgtcagctcagccaatgtgtccctacccaagccaccaatgtcttgtttcaccaagaattgtccttaaatctgttatttctttccaacccatacatccttcaacattctctagggaatgggagcgtgtgagaggataggatggatgccgcatgccatggagatgcttgcagtttttccctggctgttttagagaggctcggggatgtctttatggctgggagaaaacagcagcacaagcagcatttttttttttttttcagggattgtcagaaggaagtgtggcccttctctacattagcttgaagcagtcaggaatttcttgatctaatttctctcccaagacctaattatggtcatcatatcagctctgtcttaaaacagcctgtcataaaaggggaagacaactcttcagatgggaagtctagtaaatggtgcagaggacagagaagctgccatacttaattttacagtaatttattattctttgacgttcactgttgccctgaatgaaaagctaatctaaatatttttaagtaaaactgttttttctcttttaacacttcctttaatttgcttatataattaatctattcttttaacccaacaccctacctagggtagcagagtgtagtttctgacagcttaaggtagtgatataataaattaatgcatgttgattgaaaatatttaaacactttccactgactagaaaaggtaagataaaaattgttttagtttggtaaataaaactttaaggtgaacttttaaaaatgaaaaatactaacaaagcatcccctttgcatgtttgaagaatatgatggtttgagaactatgttaaaataacaatttccaatgtcaatgtcttatggcatgaggagccaaaatgatgttagcttaggagctgttccaaatggccatgtatgcccttttctctctttattctctgacattccccctcaactacccttgttcttcttccccaaccctaaccctcggtaaaagtttcaaaacatatgttggtcaacagtcaccttcacaatttttgtcatctctatataccactgttttgctatttactgaatatttttctttctttctctctctctctttcttcacttctttcttcttttcttttcttttcttttttttcagagacatggtctttctctgtgcccaggctggagagcagtggcataatctcggctcactgcagcctcaatcacctgggctcaagcaattctcccacctcagcctcctgagtcgctgggactataggcatgtgccaccatgacctgctaatttttttttttttagagatgagatagtactatattgcccaagctgagtatttttttctttaagttacctgaaatggacccttttttattaagccttgtcccaagcaagatatccattaaatatttaactatttatttatttattgagacagggtctgcctctgtggcccaggctggagtgcagtggtgcaatcatggcttaccgcagctttgactcctgggctcaggccaccctcccgcctcaccttcctaagtatctggcactacaggtgcgaactaccatgcccagctaatgttttgtatatttttcttggtagaaatgggatttcaccatgttgcccaggctagtctcgaactcctgggttcaagccatctgcccacctcggcctcccaaagtgctgggattacaggcatgaggcaccatgcctggccaatatttaactatttaaatacaaaatttaactcttaaacaatgttagcagtcttcagttcaaatacttttgtgtccttctggcagtatgtgcaccgcccttgaagaaggactgcaataaggcacagtgaccttaagctaaagacacctgtgccttacactgaggcctgtgtgctgacaggggctttgaccgttgtggctcagatctgagtcccctgtgagaaaggtttctgcatttgaataggaccacagccctctaagaggtaggaaaagcaaaaaagcaaaaaaacaaacaaacaaacaaaaacccaaaacccagatgggttgtcctttccttcccattgagctagagggaggctccagaccatcctgccaccctctccccagggtgaaaagcaacttgcttcccgtcccaaaatagaagtttccatggttaaacccaccatccctgcctgatagacaaggaggcagagttctttttgttgtgcttggaggacctgatatttttattgaggcctattttcactacctcaaggttacttactttctgccccaacattccaggaaatcctgggaaaccctgtgaaaagagcaacaaataattgtgatcacctctgaaataacacctgaaatggctgtggacaggctttgttggtcattttcaagatggaggcctgtccatcagtccatcatcagtccacggatgggggtgggtgggggctgctacttgcactgacatttatcatttctatggaaaggttttctccattaccttttctcctttgggacccaggtcacccttttcacctctggatccctaggaagaaaccataggagaaagtcaatgagttaatatcctgggagggaaattcaagcatttcaaactgaaaagctccctaaaccaaaaccctcattttacaagtgaagaaataggctcagatatgtcaggtgacttctccagggaaggaatgctttgtgatctacttcttgttgaaccccaaagacctcttgcattcataaaggacaactcacggaaaattctgggccccaaatcctctctcatcctgtaggaaatttgtccacaggttgatgctgttttgatttggtttttggccaggtcagaaggttgtgtggtggtgaaagcttggcctaaagacatgcatcaccaatttcctccagcactctgtgcaaactgtgcttattctctacctggcacggccttcatttgcttatgtgctccacacgaggggcctctgcctctatggggagcccttctcttaccagcttgccctgcttcaggaggtccctcacttctctctcagtccactgacaaagggtggggaatagctagggatggtggcttcagttgcagactaaagagagacctggacccattctctgcatgtctctgattccagagccagtagcccagaccaggctctaggacaccatccaagaaaagcactaaccttttcccctctggatccagggtagccctaaaagaaagcagaaggtacatttacaatcagccctgtaggacttctgagtttggtggaagaatagaaggaatccctgaatgtggtggtaaggtatgtctccacattgcactgtgagttttagtggggttgcagcaccaaacacaaagatgtcccagagggttgtggttataccaggcctaaaaggaacattgcttttatcactctgcaaagtcctgatcaaaggtttccatctgctctgatgtccagaagcttggttcttcctgcccaagagaacagcaggaatggcatccctatgcccctgcatcccagggcatgatgttctccaaagggctggtaaaggcaggctctccaatatccgcgacattccctagtccgggactgcagccccacccagtccctatgtttgtagacagcagctgctccagagcctgacagagatctgggaacgtccatttggaccccacactgaccttggagcccattggtcctcttgaccctggcaagcccatcatacccaggtcacctttttcaccctgtgggaattagaagaagaaaagacccacggtgatattttttagagaaactgaaccaggaagtcacaggcaagattgggaaggaactggggatatcagggctggcttgtaaatctgaggaccccagatgcacccactttctccctcctgaggtcccaaaactccgtactccacatttcattcttgtgtttaagattaaatataaaatgaaaacgcccaaagtgaagcagatccccacaccaactgctcactaagatgttgtatatggtaatacttggtattttcctagcgaggatagtgagagagtagtggagggggcatgacggaactggggccccagaaaacaaggtgtcaatacacgcaaaaaacattgcctgctttgctctttgcataggaagggtcctcagaatgatttgtggttgggacttccagcacccaccctctgtactaaaaatactctataccagcactaaccaatagaaatataaggtgagccacatacttaattttaaacttttaaaagaagtcaccttaaagtaaaactaaacgaatgaagttaattttaatagatctcctttaatctaattaatcatcccaacttgtaatctatacaaaaattattgagatattttacattgtgcttttcataataagtacttgaaatctgctatgtaatttacatttacacatctccattcaggtgctaaattttcatccaaaatatttaatctgtacttagagatcataaaatttatagttgaaaaagcagattcatgcattcaagttgctccaaacatactttaacattttcaaataactgaatttagtaaaggttaattcaaatagttaaaatttaaaaattcagttcctcagtagcactagcaacattccacgggcttgagggtcacatgtggctactggctgctgtgcaggacagctcagctgtatgcagaggatttttaaaatatccttttgggacttttcctaagaggactggacacacagttttccactgctataatatagccagtaaacaaatcagagcagatggtgagatccacctgcccagctctgacttctgcagataaaactctgagtcacgcctctgaaccctctagtctatgactactagtgggaaaaacagaggcacagatggggatgtgcttgctttccatagcctgactgaggaaggagatttcatcagcactcgacaatccctctctgaatgtaggatttccatccttcagccagccaacaccaccttctcaactctccattccctgccaggtcagcatgacaggcaagagcttcccagacgcaagcccctcttaggtcatctcagggaaaccagagtggggtgctagttcctaggacaaaggagaaccacggcccctgtagaagagggtaccagccccctatttctcctcccacaggaacagagctgttgcactgatcaaggtcttgcaggccaagtgaaggaggaagtatctggggccctgtggccagtccttaagctctcttcttcttccccctcttgaagaagggattccctgactatgtgccaggagccaggaaagctgccatcttcccccctcttgttttgacaccgcatgagccctgagagcatgccacacttaccctgggtccttcagggcctggccaaccgatgggcccaggcatgccaggaacacctggggggccaggtctacccttcaaagaccaagaacaaaagtcagggcaactgggtttgtttctttacttctaataaatatgttttgtctctggggcccagaggagacagtgggttctctaggcatggctactatgaccctcatccccactctccgaagactgatggcctgacaagcccttggtgtcacactgtatcatcaaataagaccttattcttctcaagaaatggagggtggtgagaaagggactctaaacttcttggttttttaatttttgtcacttctacccacccccacccaaaagtcccctgcgttccaatgggttctttccaaggatgtgctatggaatgagataggattacatttggggagcagtagcagatgctgtcagcactctttcaaggtctttttgacctgctcagagtgcccatcgcccagaggctaccttccttgctgctaacagctcatttctgctacctgtaactgcggtttgcccttgagcaattggagctgcccagtaatttatgtaactctccttcctgcagccaatagtccagctcccttacctttgggcagttgacactctcaagctccccctagatatcagactgctaaagctcgacttcacctgataccacacctttgcctggcttctcccattctccctacaggttcctcccgagagtggtcccataataatgtattcacttgcacagggtacatgtcacctgtgtctctgcctaagccagggctatggaagagcaagccctgcaagagagagtgggtgcaggtgctaagggcctatcttgaccttgtgcccattagctaatttcgcaattagctagagatgtgaagggctcagcccctaaaccagatataccaaatcctggcacgtgtactggtttctactgttgcctcccacatccatggcgacatcactaatcaatcatggtccttgttaggcctgagcatggacaccacagcagaatatcctttgaccattgccatggagaccaccccagcacttcagacagccactgtgccttggctatagttttcatctgtgccctaaagagttgtaactttgtcttgcaaaagtctgtttaaggatcttgtggaccatgaaaccatttaataaaccatttaacaataaatatagtaatttatatttagagccatggacatctttcttggccaaagttttgcacgcttgtctataaccaagacctagaaattcagtgccagtatccactgacctcagcaaatataataggcagctgatttactccctcctgacactaatgagagccttgataacatgtgtttggttcacgcagagtcaccgtgaccttaagtaacctccatttatttcagctgagccaaaaagcaaaagccatttgtttctgtctgctctggcactttattcaaatttaatcaaacagagagtgacagtcattcaatgtcactggttggagctatgaagggtttctctgatgggtagcagagtgagatggtctggggttggggcgggaagtgagaggggtggaatttggccaggcttggcagcccccggaagaagtctgaatgcctggcagtagcaggctcctgctcctgaacaaagaagttgacagaaagggcaaggttactactgtcaccatcgagacagcagcaccatcactgtccacctgggtatcagtgaccactgaagtgcattgctgttcccccctccctaggagtgcatgcacacacatgaagcacagacgctcatgtgacactcacagaacagcgcagaccataccttccttcctggtcggccaagctccccctatggatggagaagacaggtaaggagaggctgctttggaagagatgttctggaagcagaagccttagtagagctgatgactgggcatggccatgtggctcagttgcttggctgctgctcacggcccctctgccatgtcgataggccacgtcaaaatacaccagtggtatcccatatgtgctgcagcagcccagccatcatggaacccagcctctcaccaaggcagagttagcacatgtttggaaatctcaactaggaaattctcagtgggatgcccagaaaacaggctggaattgccaaggaaagaagggttgaagaaagtagtggtccataccttttctccctttggtcctgtcttgccaggaagccccggtggaccctaatcaatcaagataaaaagtgaagaaagtatatatcagtctgaagctggatgggtgtgaggctcttggtgcactgggctcctacagcagcaacatcattctctgggcagatgtagggctccagggacccatggaggcttttcctttgccctccagcccagtcccctcctctgttcctcctctttagctttctctgagctggttttccagtggctccatggttgcaatgcttacatatctactctgtggttttaattttctccctgtaactctttgtttgcataaaacatcccaagtgcttgttgagagcaacaaaagagtcttgaataaatcccatttgctgaaaacaagaggcttcatcacctctcatatcttttcagttactcttgccaaacttccctgggggcctgacaagagacaagttaagttttgcacatagcagcagctgccaccttggaaattcccatggtcaatttgtgggtactaggtgccaaataatttttgcctttcttcagcaggaaaaaagtcttcttttttaagacactaagaatgttggcaagtaaagagtgcatttttgtgccttggagaggagctgactctagctcagggaccctacaactcactgcatcaaagctttgcatatccacagccagaatgtgcctgcaaaatgctcagtcagctgttttccaaattctccaaaacagcagagaggaaattcatcaaaattccccaggcccccactgcaaccccaggatctgcaggtgaacatgcatagtgcaaagcctgtttgaaatatgatttctttttttaaattatactttaagttctagggtacatgtgcacaacgtgcagatttgttacatatgtatacatgtgccatcttggtgtgctgcacccactaacttgtcattcacattaggtatatctcctaatgctatccctccccactccccccaccccacgacaggccctggtatgtgatgttccccaccctgtgtccaggtgttctcattgttcaattcccacctatgagtgagaacatgcggtgtttggttttctgtccttgcgatagtttgctcagaatgatggtttccagcttcatccatgtccctacaaaggacataaactcatccttttttatggctgcatagtattccatggtgtatatgtgccacattttcttaatccagtctatcattgatggacatttgggttggttccaagtctttgctattgtgaatagtgccccaataaacatacgtgggcatgtgtctttatagcagcacgatttacaatcctttgggtatatacccagtaatgggatggctgggtcaaatggtgtttctagttctagatccttgaggaatcaccatactgtcttccacaatggttgaactagtttacaatcccaccaacagtgtaaaagtgttcctatttctccacatcctctccagcacctgttgtttcctgactttttaatgatcgccattctaactggtgtgagatatctcattgtggttttgatttgcatttctgtgatggccagtgataatgaacattttttcatgtgtctcttggctgcataaatgtcttcttttgagaagtgtctgttcatacacttcacccactttttgatggggttgtttgattttttcttgtaaatttgcttaagttctttgtagattttggatattagccctttgtagattttggatattagccctttgtcagatgggtagattgtaaaaattttctcccattctgtaggttgcctgttcactctgatggtagtttcttttgctgtgcagaagctctttagtttaattagatcctatttgtctattttggcttttgctgccattgcttttggtgttttagtcatgaagtctttgcccatgcctatgtcctgaatggtattgcctaggttttcttctagggtttttatggttttaggtctaacatttaagtatttaatccatcttgaattaataaggtattaatcttgtataaggtgtaaggaagggatccagtttcagctttctacatatggctagccagttttcccagcaccatttattaaacagggaatcctttccccatttcttgcttttgtcaggtttgtcaaagaccagatggttgtagatgtgtggtattatttctgagggctctgttctattccattggtctatatctctgttttggtgccagtaccatgctgtcttggttactgtagccttgtagtatagtttgaagtcaggtagtgtgatgcctccagctttcttcttttggcttaagattgtcttggcaatgtggtctcttttttggttccatatgaagtttaaagtagttttttccaattctgtgaagaaagtcattggtagcttgatggggatggcactgaatctataaattaccttgggcagtatggccattttcacaatattgattcttcctatccatgagcatggaatgttcttccatttgtttctgttctctttcatttcattgagcagtggtttgcagttctccttgaagaggtccttcacatcccttgtaagtttgattcctaggtattttattctctttgaagcaattgtgaatgggagctcactcatgatttgcctctctgtttgtctgttattggtgtataggaatgcttgtgatttttgcacattgattttgtatcctgagatttgctgaagttgcttatcagcttaaggagattttgggctgagatgatggggttttctaaatatacaatcatgtcatctgcaaacagggacaacttgacttcctcttttcctaattgaataccctttatttctttctcctgcctgattgccctggccagaacttccaacactgtgataggagtggtgagagagggcatccctgtcttgtgccagttttcaaagggaatgcttccaggttttgcccattcagtatgatattggctacgggtttgtcataaatagctcttattattttgagatacgtcccatcaatacctagtttattgagagtttttagcatgaagggctgttgaattttgtcaaaggcctttcctgaatctattgagataattatgtggtttttgtctttggttctgtttatatgctggattacatttattgatttgcatatgtcgaaccagccttgcatcccagggatgaagcccacttgatcatggtggataagctttttgatgtgctgctggatttggtttgccagtattttattgaggatttttgcatcaatgttcatcagggatattgatttaaaattctcttttcttgttgtgtctctgccaggctttggtatcaggatgatgctggcctcataaaatgagttagggaggattccctctttttctgttgattggaatcgtttcagaaagaatggtaccagctcctccttgtacctctggtagaatttggctatgaatccgtctggtcctggactttttttggttggtaggctattaattattgcctcaatttcagagcctgttattggtcaattcagggattcagcttcttcctggtttagtcttgggagggtgtatgtgtccaggaatttatccatttcttctagattttctagtttatttgtgtagaggtgtttatagtgttttcttatggtagtttgtatttctgtgggatcagtagttatatcccctttatcattttttattgcgtctatttgattcttctctcttttcttctttattagtcttgctagcggtctattaattttattgatcttttcaaaaaaccagctcctggattcattgatttttttgaagggttttttcgtgtctctatctccatcagttctgctctgatcttagttatttcttgccttctgctagcttttgaatgtgtttgctcttgcttctctagttcttttaattgtgatgttagggtgtctattttagatctttcctgctttctcttgtgggcatttagtgctataaatttccccctacacactgctttaaatgtgtcccagagattctggtatgttgtgtctctgttctcatgggtttcaaagaacatttttatttctgccttcatttcattatgtacccagtagtcattcaggagcaggttgttcagtttctatgtagttgagtggttttgagtgagtttcttaatcctgagttctagtttgattgcactgtggtctgagagacagtttgttataatttctgttcttttacatttgctgacgagtgctttacttccaactatgtggtcagttttggaataagtgtgatgtggtggtgagaagaatgtatattctgttgacttggggtggagagttctgtagatgtctgttaggtctgcttggtgcagagctgagttcaagtcctggatatccttgttaactttctgtctcattgatctgtctaatgttgacagtggggtgttgaagtctcccattattattgggtgggagtctaagtctctttgtaggtctctaaggacctgctttatgaatctgggtgctcctgtattgggtgcatatatatttaggatagttagctcttcttattgaattcatccctttaccattatgtaatggccttctttgtctcttttgatctttgttggtttaaagtctgttttatcagagactaggattgcaagccgtgctttttttttgttttccatttgcttggtagattttcctccatccctttatcttgagcctatgtgtgtctctgcacgtgagatgggtctcctgaatacagcacactgatgggtcttgactctatccaatttgccagtctgtgttttttaactggagcatttacccatttacatttaaggttaatattgttatgtgtgaatttgatcctgtcattatgatgttagcttgttattttgctcattagttgatgcagtttcttcatggtgttgatggtctttaccgtttggtatgattttgtggtggctggtaccagttgttcctttccatgtttagtgcttccttcaggaactcttgaaaggcaggctcttcttgaggagtatctttgtggcgttctctgtatttcctcaatttgaatgttggcctgccttgctaggttggggaagtactcctggataatatcctgaagagtgttttccaacttgattccattctccccgtcactttcaggtacaccaatcagacgtagatttggtcttttcacatagtcccatatttcttggaggctttgttcatttcttcttactcttttttctctaaacttctcttctcgcttcatttcattcatttgatcttcaatcactgataccctttcttccacatgattgaattggctactgaagcttgtgcatgtgttgtgtagttctcgtgctgtggttttcagctccaacaggtcatttaaggtcttctctacactgtttattctagttagccattcatctaatcttttttcaaggttttagcttctttagctcggagaagtttgttattaccgatcgtctgaagccttcttctctcaactcatcaaagtcattctctgtccagctttgttccattgctggtgaggagctgcactcctttggaggagaagaggcactctgatttttagaatgttcagcttttctgctctggtttctctccatctttgtggttttatctacctttggtctttgatgatggtgatgtacagatgggattttggtgtagatgtcctttctgtttgttagttttccttctaacagtcaggaccctctgctgcaggtctgttggagtttgctggaggtccactccagaccctgtttgcctgggtatcaccagtggaggctgcagaacagcaaatattgcagaagagcaaatgttgctgcctgagccttcctctggaagcttcatctcagaggggcacccagctgtatgaggtgtcagtcggcccctactgggaggtgtctcccagttaggctacttgggggtcagggtcccacttgaggaggcagtctgtccattctcagatctcaaactctgtgctgggagaaccactactctcttcacagctcagttagaaatgcagaaatcaaccgtcttctgcatcgctcacactgagggctatagactggagctcttcctattcggctgtcttggaacctccctccctgaaatatgatttctgcaaaacttatccaaataacaacagctcccctcagcctgtggttcccaagtctatcagcacattacaattctctggagatgtttgaaaaatcccaaagcccaggccccaacccagcccaattaaataacaacctcaggctgggtggggtggcttatgcctataatctcagcactttgggaggccaatgtgggagtattgcttgagcccaggagtttgagaccaacctggtcaatgtgttgagaccctgtctctacaaaatattaagaaattagccaggcatgatggtatgtgcacctgtggtcccaccctcctgtgggaggctgatgtaggaggctcacttaagcctgggaagtgaaggctgcagttagctgcgatcaagccactgcactctaacctaggtggcacagtgagactctcttcccaataataataatgataataataataaatagcaatctcaggggaggaggaacaagcatcagtaatttttggagctcccccagggaatcgtaatgtgtagataagtttgagaaccagtatctttggtttattcaccttctatttttggatagggaagaggagggttttcattccaatctcttgattcttccaagccttagttctttctgtttcttgaagtggactagaactatttcacaaggtcattgtgctctagctcagtgcctctccaactttaatgtgcagatgacccactccgttcacttggtggaggggtggtatcttgttagaatgcagattctgatagaatgaatttgtcagggggatgacattctgcatttctaaccagctcccatatgataccaatgttgctggttcacagacctcactttgagtagggacagcatccacattgtgttctaaggacatgaaggtggctacacaggaccctgcatttgggcaacacagcctccacatgcttcaaaggggattgcacgaggttagagatgtgtgtgaccagagagccactgtcctgaggtcagcagaaaatcccccttttcttttctatattccatgggttctagcatgcctgagacctgttagtgtagactgctgaaggtgggaagatagaaatgcacctccgaggattctcatcttgcttttctgcaggcttccaagcttttctgtggcagcctctggccaactctgggttcaaagtcctgttttctttcttgtatccaacaagtaattacggagaacctataccaaccccgtgcactgttgtagacagggaatataatagtgagtgagatggacaatgtctctgttcccacagaccaaggtttgatacaggttttctttagaaggctacattgtcaatatcttaggctttgtgggccacatttggtctctgtcacaactactcaactctgcctttgtcgtgaaaaagcagccacagacaataaaacttcgatgttttattgaaactttgccgcaggatttgatccacagatatagtttgccaacccctgccattgagcttacgttttacagaggggagaccaggaacagaagaacagataagaaaactgtaacaggatgaaaaaatcatgcagagaattaaagtaggtcattgtggcagagagtgattgtggtggtcgtgtgggcaggagactactttaagtggttgagtgggtggtagaagaaggcatttctaaggaggtggcatagaagctgagtcctgagtggccaacaggagctggccatgatacaaaccagaaagaacattccaaacagcaggaaccacaagtgcaaaggccctgtggctaaagcaagcttggagtgtttgagaacccgagagatggtcactgtggctgagtcaacgagacaatggaggtggtatgaggtgatgtaggagatacaggccggagtcccctcttgtggggctttgtaatccaggtgagccttcaagtgtccagaagccacaggagtgtttacccaggtgggtgatgtcatttttacgccccctgcatgggaaggcacttgggaactaactgctccttacaccctctttctcctccccatggaaggctcagacccagctgtccctcaccgatggagcaccctcttggaggcaggccagaggggccaggactctgtggggtggggtctctggagggtactcttgtttgtctagaaatcctttctgcagcattttgactgtttcccctttagctttggtggggaggggtgggctgcttggtagcaatacctgggggcccagtgaggcaggaaaccatctcctctgcacctccactttcctgtgctgaacgcaggcacctctgggtccacaggaggggtcaatggttacataaggggcactgtcatcaagtgtttgtctgattgtaactgtaataaaaaccatatccatagaggtggcatcctcatttgattcccccaaaattcagtattgtagggacaattattatccccattgcatagatgaggaaatcaaggatgggaggccagaatttacctagcaaagagtcagtgttctatccaagtggctttggagcaggaagtaagcgagagaaggaaaaacagctttgtatcacatgagaaagagcagacactaagaggctctgtgcagtgggctttcctgctctaaacagaagacagcgagaggggtccggtagagtgcaccaacctgggggccgggaggcccaggggagcctagcgagccttgcatgcacggggactgcgaggtctccagttccagcatgagattcttcatgtctggggagagaagcttcagtacaaagcaacacagagttagaggtcaggcgtaggggacagaggaagggtcaccatcctggacacagacctgctccgggatcaggtctctaagcctggcagttccctgacaccccaatgactgccccaagaagatgacaccttgggctaccagtttctgttctctcatctgctcttgagacgaacctggcttgtatggattacagacacctcgtagccactttggatagagtttggaagctcatttcaggggcctctatccaatgtgtaggttagcactgtccaatggaaacataactaacgtgaggcaccaataagagcaacactgtaattttaaattgtctagtagtcacttttttacctttcaagaaggtaaaaagaaaaaagtcaaattaattttaataatatactttctttaacccaacaaaactcaaatattatcattttaacatatattcagtattggaaagttaactaatgagatagtttacattcttttctcatactacttctttcgaaatccagtatgtattttacacttacagcacacctcaacttgaactagccacattgcaagtgccagatagctacatatggctagtggctcctgaattggacagctcaggagacagagcgttgggaaagagctgagaatcccaagtccccagaatgccctggctgttgtcttctaggccagtttccctaatcttgctcttttcctcacctggtcctttctttccaaattctgctccctctcacacctcagtgtggctacgggagaactatttcctgagtcacctcatggaaacggtctgtgttagacacgggctgcagaagggaatttcataaacacttggggagaagaaaaacagaaggggaaattccatgtttgagcagctgatgggaacccaggaagttatattataaattcacctcatggtttttgagaagatgagaaactttgccaaatccaattcctgctaagaagaatctccctccatcatttatttaagatatttggagaatggacacaccccaggaactgcaaaatgtccattccggggctcaacttctgggtgacagtggagggttgaggctctcagaaaagattccggaggcagctcaggtggagtggggcaggcaggtggggctgcgtggtgtgcactgagtagcctgcactttttttcctctcataaatcccaaagtactcaccggacttcggccacctctgaagaatggtggtgggaacagtggtggtggaggaggcgtcagcaggcagcatgctttgtggccaccacgcttcttctgatccaggctgggaagggctgttcagagaaaactgccgctcgttagcatgtggtcagtgctgggcctctgtcacacccaccgtgcccagggaagacccatcctgccaccccagacttccacatctaatttctagcctgttagatgtggataggcctcctgttggctacttgacatagcaattattcccttgcccttgcctttgctagattaagatggttcataaagaagcagatgacttgtctggacactgaccattataaggttcaattctccttcctcagatactgacttgtcactttgtagatgtagcaggaaatgcaaagttcaaacagatttcatcatatgcccccagtagttgaggagaagaaagtgcttgctaataactttaatattgtactcagaaggaaattgtttagacagggaggcagccagggccagtggtagcattacttacaggacacccagacccatgatttaaaacacatacattgactctagactttacaaacacattcacgtgtcactcatttcactggagagttacggtttaatgtctcaatatatgggtagcctaatctgcagtatcaggaaataaagggagggccctgaacctttgtagctttatttttacaaaaagtctcacccatgttcaatgttagtaaatgttcaatgttgaagtatgccttacaaaaagtacacagatcaataagttacagttcaacagatctccataaggtggacgtatcctagaaaccagcacccaggtcaagaaacagcattccccagtgcccagaagctccttcaagctccaatctctgcaccccttcccatcctgaattctaacaccagagattcattttgactaattttgcactttatgtaaatggaatcatacaatatgaactcttgtctttggcttctctcttttaacatagtgtctatggaaatcatctaggttgctgtttatcattgttactgctgaatagtgtcccactgagtgactatatcacaacctactcatccattctgctgaacatcgctgatgttcattgggttgataccactacacatccaccagaatggctaaagcaaaaaggacagaatataagaaatgtggcaaggatgtggaacaaccacaactatcacacattagctggccagaatgtaaattgatccaacctctttggaaaattgcttgttatcttctattaaagctgaacatagacatatactctagcccagcaatttcactcctaggtttttaccaatagaaaagtgggtgcattcagaatcatgattgcaagtgatctttaaagtttcaggttctgactccaagcttgaatctcctccccggcatctctgaatgatgggcattggccaggaccatatatatgttctctggtgtttgcactgagaaagccctgatttgtgtccctacctaatgaatccagtgggggttattgcaaatttttcaagataaacgttttagttaagagccagcttgaatggttatagttttatttttataccaaaaagtaaaaatttctcttgaaatggccctaaaaaaaagaagaaaaaaaaagaaaagtgggtgtgttttcaccaaaatgcatgtattaaaatgttcatagcagcaatatccataatcacccaaagctatggtttttcagttctcagttttggtgtcacgatgtaccttcacttccaccccttcacgaaacctctgacctcacagaacatgcacgccacattgaccaccacaggctctcaaccttgaacccagttttctgtcttatctcccaggggccagcatctgccgaccatctccaccttgtgctccaggacctgcctcagacactagacaagtgctaagtgctccccagaagtcgccaggtcgtgcggtgtccacgggaatggtagctccgtgcacacacactcgctcgcacccttgatgatggagcattccactggcctgtgccaaagaccctcagccctctcaggcctaaagcgaccttttacgggaaatattttataaagacacctttattatccggaaatgaaattcacaaatagtacagcacgctgacagacaatttaaaaaatcaatacagtgctcttaattctacataaaagagaaatacaagaaagtgatttatgggccaggcatggtggctcatgcctgtaatcccagcactttgggaggccaaggtgggcagatcacgaggtcaagagatcgagaccatcctggccaacatggtgaaaccccatctctactaaaaatacaaaaattagctgggcacggtggcatgcacctgtagtcctagctactcaggaggctgaggcagaagaattgcttgaacctgggagatggaggttgcagtgagctgagattgtgccactgcactccaacctggcaacagagtgagactccatctcaaaaaaaaaaaaaagaaagtgatttatgatacaaaagtaaacattttgattataagtggtcagacataaccatattagaatacataatgctgtggtttgatgctcacacttacatgaaatcacagtgaatgcaacagctcaaataaagattatggtattggcaagtctcatgctacaaggaatgtgtccaccatgtgatgtgattttctgaaataataaacaacactgggtaaaattcccgactagataaagcacaaccattactccataattgtagtcttagaaaactcaatttatattataacagtgctttaaaaatgctgcataaggccgggcacagtggctcatgcctttaatcccagcactttgggaggccaaggtgggtgggtcacgaggtcaggagatcgagaccatcctggctaacatagtgaaaccccgtctctactaaaaatacaaaaaaattagccgggcgtagtggtgggcgcctgtagtcccacctacttgggaggctgaggtgggagaatggcgtgaacccgggaggcggagcttgcagtgagccgagatcgcgccactgcactccagcctgagcgacagagcgagactccgtctcaaaaaaaaaaaaaatgctgtgtaaaagagaattcagttctagaatgagataattatatataagtacgaatgttccttgggacatttcaaagtcatggaggatgtgggacaattctatcccaccctttgcaagacagctctcactcctgacccggctcaacagacagtgatgctacccatcccagcctttgaaacaaccaaaaataccttgaaaatttccaaaatggccccagtgaaaactgttggcctatccaatgcttggtgcttagcttggtcacaaaaagttccatagaacccagcactcaacgccaaagcagcatccactccaggtcatacaagttaacgagggactgaaggaattcagaaaaacaggaacaacaggtggccaccagctgggataaacctagctgtcttttgggaaagagggcattcatgctaattctggaaaagcaaggagaatttagacaggaagacttccagaccacgaaaatatctggggaagtcatgcatacttgagctaggccttgaagggctagctggggaggtggctgatggaaggaggggaggctccccagggagcgggaggaatggcaggagaaagacccatgttccattcagggctacttggattgtgagaagcagagcttcactcacatgggctctggggaaaaaggagatttattgtaaagttaacaactgtcagaaagagctggagccaatgagtcaatgggacatgacactgtcctggtatttctctcaccttcctcgatcccctgtcccccatctccccttttatgcttctttctgtgcatctgatccattccatcctctttggcgtcttcacgcccatctctccatgacggctgacccagtcttgcctcacctcttttacctcccccatctgctttgtctggaacatccccttgtgggtcttagttcaaatagccaccacagggaatctgtttgcccagccaggtgacaggtcatgggggcagctaagcagagcctgccctggaccagactcagacccagtctttagcaggatctcagggtctgtcaccagctcaacagaggctgtgggaggagtttctcctgaggaaggccaggcagacaggcactccaaaatatgtcaaacaggctaggcgtggtggctcacgcctgtaatcccaacactttgggaggctgaggtgggcagatcacttgaggtcaggagttcaagaccagcctgaccaaatggcgaaaccccgtgtctactaaaaacacaaaaatttgctggccgtggtggcacatgcttgtaatcccagctacttgggaggctgaggcaggagaattgcttgaacttgggaggcagaggtttcagtgagccgagattgtgccattgcactgaagaggaagctcttatcttaaaggaatagtgactgttggggtcaggatgcagggaaagctggaaagttaatttggggctagattgtgctgttttggataccccacaaaagggtttaggctttaattggaaagtcgtaggaaaccacggcaggtgcagggtaaaggagtgacaggatcaaaatggtgctggagaacactgtgtgcaaggaaggtgcaggtgtggggaggacaggcttggagaatgggagcatgcagcagggcacgggacaggaagggagggactgatgcagagaaacggggccaacatgttgcaggagggaagaagcaggaagaatcaagggtggttttgaagttgcagggtacccagggcaacagtggtcagagtttgagaaagaaaagtcacagcaggcactagtttatgggtgttagacatttattcatttgagcacactctttgccaggcactgggccaggcctgtgggaagcagaaagtacctaaatggcatctgtagttggaaaggcttgcagagctcagaggccttctgcttgtaccccactccctgccctcccacaagcagcctccactagatgccgtctccaccaggaagctttccttgacttcccaggcaagattgagtggccctgctgtttttctctgggtttacccctatgttaggtttcctccatggggaaaaactatttccttgtatccctctgaccaaactgtgctttctgggagagcaggagccagcttttatccccagggtctagcactgtatctggcatatgctagacactccacaaacgtttgctgaattaataatgacaaacaccacatgcaaggcaccatttaagtgattcacacatagaaattcacctaatcctcacagcaaccctaagagctaggtactactcttgttatcatcatctccattttacagatccattaactgaggcaaagaggttaagcaatttgtccgaagtcatatagctagtaagtgacagagccaggcagtctggttccggagcccttcctcttgagctctacaccatgactgcatgtggtagaaatgaaggtctggagcttcaagtcccataacaacaacttggggctatagcatcagtgccctccaagcaaaggcttcagggaaccaagctgggtttattgactcactgcaaagagggagaacacacaccggaaggaaccgtggggcatctcagttagaggatgctgggaaggactgatcctagggttggggattttgctaagtgatggaggggagactgaggaaatgaagtctggcttcactctgaattggatgccatcaggaagaaagggccattctataattgagtaccttaattcatatctagaagagagtggagcaagaccaaagctgtgattggttttttaaacagcagcaatcactcatattagcaaggataggagaatgtttagttacttttgtggttggatgatagtcctgttttcgtctgtgttcagttgtgattatcaagtgattcttactttcttctcaatccatcaaggtcacagggtgaccctgtctgaagttggtgttctgtgacatcgcttctgtgttgcaaaacaccatgccgagctctgagagtcagggcagctccagctgtcacgggctacttttctcagtggtaaaataatatggatacattgttcccgaacttgacattaatgccaatgtattcctcctcaagcttctccaagtttcctagagtgttgagtcgctaggagtgggcagcttcagttgtagggtggaggaggctggcaggttcacaccaatcccggaacgtttttaaggtcccctggctacagtttctcctttgcttctcttttgcctcagcacacagctaagggctgaggctgcagtgttccaaaagcacctgggaggctggcaggcccacactgctaatatgcactcatcaccattatttttccagaccatatatggcctccagtgccttccttcacccagcaccctgtgtggccttccactgatgaaggaccttgtatcatttaaagcaatcacttctctcctttcttcctggaaattggagacctcttcagtgaccacaaattatcagctgcatttctggctgaggcttctgcattgttcggctcccccaccccatccccctcaccctttcccccttgacccactttcttcccagcaggggaaggccatctatttctgccctcccctgactccctgaagctatttgtttttaggagcctagtttatttacagctcattcctgttcagaatatttccatcaggtggacgtgtttgggagcagcttccccctccctcctccctcccagtcaactaagccaggacttcacatgtctattttggtgtcatccgagtggcctgtgggtctttctcatggactgtctctatagaattgtgtctgagctcaggctccagtctggaaaagccccggaaggctctgttgtattgaaagcaatcctgtgcgtatctccgtggagcctgcagaaacctgggagcagcacgtggctcagcaccaggcagctgccttggaaatgccaaccatcacggaacttcaggaccgcatgtcccaacttaaagacatcaagctcatgttgtatgtggccagtgcattgccaaattatgggtaattgtttaatgcaggctttggcaagtgtttgaagcttttgttgtcgatgatgctggttttgccctttggactcaatacccattcttgaaaaggagactttctcttgtttcatttcaagaaactgaggcacatctttggaaagcgattttctccaatttactcttggaaagacatggatttgattaaagagtgttaagtctaggtgcaagtggccatgtgagccagtacaactcacttactcaatctgaaacttagtttcctcatctgtaccacaaagagttttgcccaaatcatctccaaagtccttttgcctttttttttttttttttttttttttgagacgaagtctcactctattgcccaggctggagtgcagtggtgggttctcagcccactgcaacctccgcctccagggttcaagccactctcatgcctcagtctcctgagcagctgggattacaggcgagtgccaccatgcctggctaatttttgtatttttactagagatggggttttgtcatgttggccaggctggtcttgaactcctgacctcaggtgatccgcccacctcagcctctcaaagtgttgggattacaggcatgagccactgcacctggcctcctttagtccctttttaaaataagtatgacaccagaaccaccactgtatccatcttcatctaccctcttgcaaggccagccccacaataggttactggaaatagccatttccatttctgccttctgtttttccatcaagtagccttccctcccaccccctcaatccaacaaatgtgtcattagaaactgtcaaaggaaagaagtgacataagcatcctgcctcagcaggttgagagaattacaagtgcagccatttaactgttctgcacctgcctgtccagttggtggactagtcagctttttacttcctcctcctcttttggggcctttccctgcctgtgggaacttgcatgagagagacagaccccaaagaagagagaaagccaagggcacacgctgtatggcagctcagagtgctttgactttattgtagtgagttgggtctcagctacagtaaagttcttacattaactgaatgcaatttgcccaaaattccccccaattcacatgttccagagaaggctgcaccctacaattttccttcaatccccacaacaaaccttgaaagacaaattctgatcctaaaagttgcacgtaatttgaacttctctgaaagaacatggtagagtttgccttctgctgtatgtccctgagcaggcaaggatacaacctacaaagaacaatttgtggtttggtggctgtgcctctgagccaaattacccaaggcagtccactcaagagtgatggagactgtctcagccacccaacgccagcgggggcccagactacagaacacgattttacttcaaagccaaggtaccagctgccagccaaggtaccagctgccagcacaaggtacttgtgtcagtcaaggtcacaagagggacacagacaagtgcacacacccgttagcatgtatgccaggtccccaccaactctactgtgaaacccctttgcattgcaacttcaacactggctgagcagtttaaaatttaaaggctttcacaatgagaaacagccctgtgaaagaaaaacttaaaaagaaaaaaaatttaaaggctgctaaaacctcctagtacagtctgctttccaagagtcttttttccaaaacaatgcatgtgcatccacacacacacacacacgtgcacacacgcacacacaactcacccaagcagcctgccgagtaacagagcagtcctgaaatgatgagcagatgagcgaggctgaatgatgagcccgtcattgtgaggcagggcccaaagcggactggccagggaacactagccggagacaggctgagattcgtcacgcctctgagtgctcccagtgcctggcctgtttggcattaggggtgggagttggccaatccctgctttgatgttgcttctgctccagatgccaggggtctggagccagtcctgagctcctgggagtagcaatgggtaggcagccctgctccagctgcccatgaacactgctgtaggggaggcttggaggacaagagtgccttcagcccaggggaggatatgaggttgggagcccagggatacttatccccctgcaagccaagaggaaattgagagcaatcaaacaggctgcttttcatttggctcaaaaaccgacttgactcaaaataccacagcagtattgactgctctggtaagcctcaaagtcaaccccccaccgagaccgtccaaggggagcctgccctcctctgcttcagggaagaccttcatggccaggggtctcagctctaatcctgtctgggccaaagtgttgctgacaaagctaaacgtaactaaaacaacaacaacgaaaccacaaacaaacaaaatatatagatttccaaagggcatgtaggcaagtctttttggatgaagcggcatataccagttacatgcttaaatctatctggtactttataggcacacccagtgcacaagcatggacacacacaatattttagattataaaagacaagattattattatactacttagcaataagcactgttgttttgatcagcttagtaaagaccataagctatagcaggagtcagcaaacttttgctataaaggtcaacatagtaaatatttaggctttgtgggtcacatggtctccgttacaacctcactttgccattgtacaggacagcagccatagacaatacatgaaggaatgagattggtcatgttttgtaaaagtttacacaaatataggaggcaggctggattcggcccacaggctgtagtttgccaagccctgcactataaccttcaaaagaaaggacacttatgttcattcattcatttactgttttattcattcagaaacacagtaagtaccaaattgtgcaagacataatgactagacacagttcccgcccttggaatgtgtcgttcagtgtcacgggaagagtactggccctggagtcatccaagttgggcttaagtcctggttttgccacttagtagctgtgtgaccttgaggaagttattcattctttcggagtctaagctttcttacttataaagtgggcgtgcaaagccgactttgatagtttgctgtgaggattagagctacagcttttggaattcctggcaccgaataagggctctcttattgacatattcttggataactgttgtataaggtaaaaaaagaagagtggctaacatagggcagggatgcctgaagggatttatagaaggaagaaatgggtaacggttgaggggtagagggtccaagtgagatatcaaggaaggattcctggaagaggtgggatttgagctgatacttgaaagcagagacttgctatatcaagatgggaggagtgggaggtgaggcttaggctgtgttccttctctggggaattcccctttgtccttctcagaaactgggtctaagacctcagagaaagtagcaataaggccagggagtcctcagtcctgagtcctagagagttgcagaagtatctgcatcacattttcctgactttctctattctgagtcatattcttgcagctcttcatttttcaaatttcatttcgcaaaccttcagagatggaagttttgccacttttcacaccaaaagcacttactgtgttttttttaaccacatggcatcaaactttttctaaaaaggtttgacatatgtaaaccactcagctgtagtttgtttcattattgtaaaaacaaaagtagctggactagatgatcgctggggtcctgtccaacttggcaggtgtttgaatctctatttgaacctaatggttcaggttcacgaatatcttctgcctcttctctgtgtttctctccttctgctactctcttttctgtctctgtctttctctgtctctgtgtctctctatctataactttgtctcattctctggcattgtctctgtctttccaagcatgcaccatttaatttaagtcaaatttctggatgtatgctcaactacttttaattgctctccagccaagtgtgccagcctgggattaagagccctggtctttagccctggcactaactcactgtgtgacctaggacaacccatttcccctgtgggtctggatttttctagatgtacaatgaaagccttggaccagatgagctctaagccctttccaactttggcatctctcagggtctgtgattcctgaaacatcagtggttcctagacaggggtgaaggatctccccttttaccccttggtgaacaatctttgccctcaagttccctcaggtgccttagcctggcaccagttcaccacggcaagagctgcctgtaaaatctaattcacaatacaagtttctggggccttcctgcagctgtcagcaggtgtcacattcacagtattttgtcttaattacagctctgggatttatcagccaggctagagacctcttctggaatacgacatccccgggagctgttccaggtgctcctgtccctgctgctgccacacacaggcctgttccctgccgatggggctgaagtagattctgctttgcatgctgctcctgctgtgtctcccaccactacctcacagagagcctgtgtgacatagataactcccacagccttcccagggatccagaggcaaagacatctacctgtttggggcagtgccaaggctcccaccagccctggagcacttcacatccgctgtcccatcccaaaaccttggtgggcagagaaataggtaggaagacctgagttctaccttcccattgacaaccattctttcctcgggcaagctttggtcaggttcccctgagccctcctcttgactaggctttgaacgtgggcttctgtgtccatccttgcagagtccagttatagccagaatcttgataagtcagtttagagagaatcccccacccttgagaactgatcaacctggtctgccttcagcaagaatcctgttaagttgtttcagccaaaatccccctatcatgatgtctcctcttactagtttttaatccactgacccacccaacctgcttcttggctataattccccacttgtccttgttgtaatggagctaaggttgatctctgtgtcctattacaatagtctttaaacctattgcaatagtcttggataaagtcttcctcaccattttaaccagtgtcagaataattttttctttaatctcacctctagatccaatggttttgtttactcaggagagtcttgtagaagactaatctcttgggaacaaagagttttcatctatctcatctgctaacttgcactgatttttttttttttttttttgagatggagttttgctcttgttgcctaggctggagtgcaatgacatgatctcggttcactgcaacctctgcctctcggatttaagagattctcctgcctcagcctccggagtagctgggattacaggcacctgccaccaagcctggctaattttttgtatttttagtagagatggggtttcactgtgttggccaggccggtcttgaactcctgacctcaggtgatccacccgcctcagcctcccaaagtgctgggattacagacatgagccaccatgcccagtcttttataaatttttttttaaacaaagtctccctctgtcacctaggctggagtgcagcagcacaatcctggctcactgcaacctccacctcctgggttcaagagattctagtgcctcagcctctggagtacctggaattacaggaaaaacaccatgcctggctgttttttgtatttttagtagagacggggtctcaccatattgcccaggctggtcttgaacttctggcctcctgtgatctgcccaccttggcttcccaaactgccaagattacaggtgtgagccaccacgcccggcctaacttgcactgatgaatacaggtttcctggaatgctgtgttaagaaggactctgaggaaagagggtcatgacttgttagtatcatcctccctgagatgaggggaaggagcattgcctgcgctgcatacttgcagactcgtttggcaaaacccacatcacgaaacgacgatgacccatgctcagcatttcccaggcattattgcatttaaccctcacaactgattatcctcattttacagaggcgaaaaatgactcttggagaagttaagtcacttgatctggaccacatagcaagtacagaattggggtcagagttccaaaggcaccttgcacacagccctaggaggaggtgacctcctgtggtcatctgacgctgacccttggtgatggctcactggttcccaaccacttccaaccttcctgctgtcctcactgctctagtctggtggggcagtttccgggttagctggctgcctcctctactaactcccagccactgacttcccatcagaggaccttctctgagttgagactgtgtggaaaaggctaacattccctccaaaatgtgtgctccctcttccataggccagagtgagccctgtgaagtagctgcatttcccagccctctgcagtatagagagatgggggcatgtcattattcttgccaatgattctgcctgggtgcacagactcaattcctgggggacagtggagccacgggatgtaaagggcctgcacccctgaatgccagaatggaggtgcactgcccccaaccagggacatggactgttaggtgagcaaaaaataaattttgattaggataagccactaaaatgctcacctgttacagcagatagcattgccctaacccagtagtgaggtgccaacaatgggacacattccgtgatgttccccattcaatcctttgatccccgcaacagccccacaaggtatatattagtactgtcatcctcattttcaggtaaggctcagggagattaagggatgcacccaaggtcaaacacaaccagtaggcagtaggccaggattgaatctggatgtctgactccagagacttctggaggttcagttaccagcacacggtggagatcttcctccaccaccaccacctagagagaatgagcaggaaacctcagaagaaatggcacccaaaagagccagaagtgtcgcctcagccagctaaggttggaaccacttaccaacgcccagaatcacgtctttccaatcaaacccaatgactgttcatctctgggtttcagtttcctggtttgtaaactcccatgagtaaacaatctctgattatcccgaccacagagagggttcaatcaggtgtgctggtggtcttcaatcaaacatggatttacctcccctattctattcttcaaagagggtgacaaatctgcaactcacttgaaatccatcaataaaaaagattaataaacagatatatgatagagtaattacagcaaaatgatagccagtgcagaatcgctgcggttcgtgtattggttttctagggctggggtaacaaagtaccacagactgaatggcttaaacaacagagacttgtttctcatagaccttgaggctggaaggccaaaaccaaggtgtggctggtttgttttctcctgaggcctctctctttggcttgggcatggccacctgcttgccatgtcctcacatggcctctcttcggaacacatccttcgtgtctctttgtgtgttcagatttcctcttcttataagaacaccagtcaagttggattaatgcccaccctaatggccttatcttaacttaatcacttttataaagacctcatctccaaatatagtcacattctggctgggcatggtggctcatgcctataatcccagcgctttgggaggccgaggcaggtagatcacttgaggtgaggagttggagaccagcctggccaacatggtgaaaccccttctctactaaaaaatacaaaaattagccaggtgtggtggtgggtgcctgtaatcccagctacttgggaggctgaggcaggagagtcgtttgaacccggaaactgaaggttgcggtgagccgagattgcaccactgcactccagcctgggcaatagagcgagactccgtctcaaaaaacaaaaccaaaaccaaaaccaaaagaaatacagtcacattctaaggtactgggtattactggggcttcaacatgaatttgggggagacacaattcagccccaaacagtggacatattggtgttccctgaacaattatctttactttctctgaatgtttgaaattattcctaattttaaaaagaataccattaaaaaattttagatagtcaacagagaaccagaagatatgttcacaaggattagggttgggagtaggtcagcccaactcccttgttggcaaatgtctaggggcccctggagctgcacagagctaaggcaccagtgccacctggaggaacctgaagccgctcattgagaggccttgagcaggtcattgaatcactgcaaaccatataagaagttattctcttctgtctcccacccctaacccacagagatgtcttgaggaggaaaagtctatcctcactacaaggatgaaagaaaatcagtcatctcgtgtcggtcattattttatataagtcatatatcaaaaatacctcctttgcacacacagagtcaaggaaacaaatccatccccctttccctgacaagagaattattttggaccttatctaaagaaaggcatctgctttttgagttcaagttctaatttgaccaaatggcatgtggtaagtagagaggaaggcggagacaatgctattaggagccaagggaacataaagaaacctctccatggctggctgcgccttgactctgaatttgattacagcagccaacataaatcagccggtgctattaaatcttctgccagtgcttgacaggggaggacaagtttgtagaattattcgggagatctggccataggtcagagacaaaaccttccagctgcatcgggcccaaagggtgggttatttccaacacctgctgacaactgtgactgcgtggaaagaccctgtgcttccagccactacgtttccatgccttcatttttccatggtgacagtttagctctataggcacttgtaattcaaaaccacctggctcacttattcctttccctagatccatccctgcaccccccatcccacctccaggatctattgtccaagggtccacaacaggtggggaggagggaggctgggttcctgggagtcccatggctgcccactggcacagactggcttctctacccattggtctcaaagtcactaaaacccttggattccagaaattggggagcctagggttgatccctttggactcagttgagcactagcacttatcaactgagcaagttggcaagataaaccttaggctttttgcagcactataatcctgtgattctaccaatctggaaactctctgagatctcaattctccttgctgctttggatctaaggacttttaaagacaaaaaattccatcttgtgctccagatgaaaggtagtattttgtacagatggtgttttgtttaattgtttagaataggtattacatgcatgtgattcaaaattcaaaacatacaaacaagtatacattaaaattctttctcctacccctctccctcagctacccagttccaattatttattaccaaccattacttagttttctatgtatacttctgggaatattttgtgcatatacaagcaaataggtaggtataatattttcccccttttactcaaagggttacttgtaatattctattatacatatgatactccctcttggtttcttcacagtatttttgtttaaaagacagcatttcattatgctgcccaggctggagtgcaggcataatcccactaatgatcagcacaggagttttgacctgctctgtttctaacctgagcgggttcacccctccctgagcaatggggcaccccgctcctggaaggacactgtggtgatgccaaacttggtgtggatatcccatcatcatagtgcactatagcccagaacttctagattcaagcgatcctcctgcctcagtctcctgagtagctgggactacaggcacacaccagtgcaccaggcttttcacagtatttctaagaaattattctgtaactacataaaatgcatgcacattgttttcttttctatttttctcttagagatgaggtcttgctacgttgcctaggctggtctcatattcctggcctcaagtgatcctcccacctcaccctcccaaagtgctaggattacagctgtgagccaccgtgccaccccactttcttttctatggctgcataatatccctttctttggaagaaccataatttgttcattctgcccccattgatgtgcatttggatgatttgcaaacatctgctgatgcaaacaatgcaactaaataaccttccacatgcatctctgtgtatgttggtaagactatccattacataaattcctagaaataaaaatactgggtcaaaaagtatgggcacttgtaatttttacacatattgcctaattcatctccagaaaggccccagcaattcacgtctcctcctaggagcagtggatgagagtgcctgtttccatacaccttcgccaacagtctgatgtttgacctcttgaattttgcctacttgataggtgaaaagtgggtctcactctgttgcccaggctggagtacagtggtgcaatcacagttcactgcagccttgacctcccaagctcaaacaatcctcccacctcagcctcccaagaagctgggactacaggtgtgtgcaaccacgcccaactaattttttgtattttttagcaagatggggttttgccatgttggccagctggtctcaaacacttgggctcaagtgatctgctagcctcagcctcccaaagtgctgggattacaggcgtgagccactgcacctagccttcagcatggttttaattttcatttctcatatagtaaatgagactgagaatattttcaaacattttgaagccatttatactttttccatttttttcattgggttgtcaatttttctcttacattatttttcctatatataggaaagaaacactttattatatggcttgcaaatattttccctagtttgttttggccttttgagttggtttttgccacacattatttttttatgagaggcattggtggttcagtggtagaattctcgcctcccacattatttttttatgtagcagaatttaatgtataattattttcttttatggtttctgggtttttccaaacacccaagttacccaaaaaatctcacaaggttttttctaatcattttatagtttcatattttatatttaaatcttcattcatttgtaacttattctggtgttttcctgtggcctaaagcagaacacaaaaacagtctttaaactaccttaggtagcctgccaacgccagctgtcacaactctcaacaacacatattgagcactatgtgctaagcatcggcctacaaccggaatgttgccttcatttgaaacattacttatctgagataagtaaactgaagctcaaataagtgcccaggtaagtggtagagtctgacttgaacatagatgggttgtctccctgtcttgattgctttgctctcacacaaactccaaccatttgtataacaagtagccaagcatattgtaggcggtacaataaatactggtcatttgattgaggggaagtatctcaaatgctatgtatattaagtaatggccataatgaatctagagacggaaagccaggtttgataagtgaataattcatcaaattattcatcaaataattccacaaagcccccatcaattcacatcccctcctaggagcagtggatgagagtgtctgtttccacacaccttcaccaacagtctgatgttacaccttttgaattttgcccatccgatagatgaaaaatgggcaaattttcagtctcattcattatataagaattaaattatatattataaattgtatataattttaattatatgaaaattaaaaccacactgcaggccaggtgtagtggttcacgtctgtaatcccaacaatttgggaggctgaggcaggcagatcgcttgagctcaggagttcaagaccagcctgggcaacatagctagaccctgtctttactaaaaataaaaaaaattacatacataataactataagaagaaggaggatcttaatcaattcaaatggattttattgcttcaattagaaataaacattgagcaaaatgcaaagcggcagcagatgggtatatggccagaatattgggcatctatgtcaaatcagccactatttgctggcattccacttgaaaatctcatatttaatcattttcctctgactgcccaggaggacctgcactaggcaggcctggtgacttgatggccattgtcacctcaaaggaagcatgcaagacagatgccatgtggacagagggtctgttctgatgtggatgaactagatacagtaagtggcttgtcttcttgctaggttttgcatagagctgcccaatttccaaaaagtggacactctcaggattgcagtgccttgtggggtttcctcctaagatcacccctgtcttagaaggggagaagctttctccttcacagccaaaggaagagctcctgcctgtgaactttgctggttagcagacctttctactgagaactcagaatggctaaggtgttgttatcaggtgtgagcatcccatgtcctgaaagtcaaatgttgcccctcaaagtacaacagtaattcctgagtacatattctgacccaggcccagggctgggcccttcccaggctctctccttggatccttgcaatgatgttatggattgtatattccccttttccaggtgaggaaaattgattctatgatatccaaggtcctgtggagttgggattctgaacccagacctccggttccatagcctgtgcactgggatgtccccaactcagcctcaggctttagacagagagtctcagttctgaaactggaatcttcagcaccgaataagagcagatggggctgggcgcggtggctcacgcctgtaatcccagcactttgggaggccgaggtgggtggatcatgaggtcaggagatcgagaccatcctggctaacatggtgaaaccccgtctctactaaaaatacaaaaaaaaaattagccaggcgtggtggcgggcgcctgtagtcccagctactcgggaggctgaggcaggagaatggcgtgagccccggaggcagagcttgcagtgagccgagatcgcgccactgcagtctagcctgggcgacagagcgagactctgtctaaaaaaaaaaaaagcagatgggatgatagtggaatgaaacatcccaggaggaggcaagtggctgaattccagtttctctccaccatttggaataatggttgcaaccagtaattgagagcaaactgtatgtcaggtgcagtgcaaagctctgtaggtattagctcattttatcctcatcaccgtctaaaatggagactcttattatctccattttacagatgtggaaactgaaatattaagaaattaaaccgtggctgagcatagtggctcatgcctataatcccagcactttgggaagccaaggcaggtggatcgctgaccccaggagttcaagacgagcctgggcaacatggcaaaaccctgtctctacaaaaaatacaaaacttggctggttatggtggcatgtgcctgtaatcccagctactggaaggagcgctgaggtgggaggatcccttgagcccagaaggtagagactgtagtgagccgtgattgccacagcactccagcctggtgacagagtgagacaaggagggaaggggacaggatgggaggggacaggatgggaggggacaggaggggaggggaacagaggggaggggaggggaatggaggggaggggaggggagaaagagaccaagagagaggaagggaggaagggaggaagggagggagagaggaaggaaagaaggaaggaaggaaggaaggaaggaaaccaaaacaaagatcacatggccaagatctctcagctaatgggttacggagactcactcaaatccagagctgtgtgaatgggaactccatgccttttactctcacataatgggttctcagtgccaatgctcagaagagaaatacacgccaagaccccttctttgtgtgggtgctaattctgtaaatttgcaaatagcatgttagccacaaagtcagggaaagtctaagtctaagaggatatttaaagtctggtccaccccttaattttacagatgaggaaactgggtcctgcaagagagcaaatgacttgtccaacactacagatgtgtcctaattttacctgaactcctaaggactgcgctgcaagtctgtctaaaaacacaagtaaacaggcaaatggccaaccccctgcctacatgtctccatatgatcttctactggacatgaacaaaataatcttggcagtcatgcccagggcagccggctcctaagcctgtccagccaatgcactcttattctcaggactccacagcagagggaagtaagggccagagcagatactctggggaaagcatttctggggcccagattgttcctaaagtcacctcggcccttcaatcctcactttctactggcagacaggaagagtgaggggacaaaccacccaaccaatgctgctcctgcagggccctgctgctctctagagacaggggactcctgtgttttccaccatgatggttccctaccatgaccttgctccacgcagctctcgagaagatcgacagaaggaaaacagattgtttcctcacctggagcctccctaattcctggacactgtgctcagtggttgagaatttcatttccagatgaccacagagaatctggaaaccttttgggggccactccatgaggtccaccccagtaaggacggtctcagaagccaagctggccctgttggacacaaagggcagtccagtttcaactcctcatgatcataacccacccgacagtcccctcatacgggggacaagtccaaacactggaacaaacccggaatcctagtgaagtaagaagagcaggtgggcaggaaagtctctccaagtaggatggccaatgtcgccccattccctgtcttcccgggtccccaagaagccccatgccaggcccgaaacccctggaaagtcctctgtggagcatggtcccaggacagaactcccagcagcagcaggaaagctcctgatgccttctccaaacttctcaaagaaggaagaggagagtggtacagaaggatgagtgaggaaagtgtgggatgcctgggagggaggaacctgcccgactcacaccgatgcttccttcttttctttcctctcttttttcatttgcagcccgcagctggttgatggtgcaaagcctgtagcagccacgaggcctctccttcagctgtcaccagctcccaaacacgcgccccatgcctgtgtttatgctggttgccatgagagataagtgcgggcttgaatggagctaaatgctcctgggctgggagatggaagagggccaggtgtatttttaaagcatctggggaagccggtcaccacgagaagcctccttctctgggcaacgtgttccttctttaggggctggtttataaatgcaaagtgggtggaagctgagtctcttcttttttgccgtaactcactggatattttaagcaaaaagttctctgggttgtatttgggatttttgccttttgacacaattaattatggaaaaagatctgacctcttgccatgtgtagagacaccaagaggttctggaaagaatgacaggaaatatgtatatatcacacattgtatgccaggcactactgaaagtactttatgctcataattagaccacttaatccttacaacttctctgggagtgaaatcctgcttttacagccatttcatagacgaggaggctgaggcaccaacagggtaatttgccaaggtcacaaagctaagggaacacaggatttgaactccagcagtgcggcaccagaggccctactcctaaccactctgcgattctgcctttgtcatggtttggggtcagaagttctgatgtggaatgttgacccaggcactgtgtgactgcacctctatgaatgttcctttcttctttagtaaaataggggtactaatggctaccttgtgacattgttgtgaagattaaatataatatgtgtcaagagtctggtgaccagaaaatactcaatgaaaggtaactttagtgtttttagtggtggttccatggcccgctggatcccaacttctgcatcccgacagggaagggctgctgagctataactgttactgtccagagaggcgatggaggcaaggaactgtgtaagggccagcaggacacagctgttctctcacactatctatagcagaggacacttccctgcccacattcatcaatcccgcccattcgtcgatcctgctcatgctttcagcttcccactacagagtcttgtgtctatgccagagcgcttctccaaccatgggaagttgtttggggtaagcaggaagaagagagtggtgaaaatccccaggagttgatggataaatatcccagtcccctgcctgtctccctaaggcccccagtagaattgagccccagttgctcatagcagtaacctgctcccgaacacactccatactgattgccttctcttccctgtctcacttccccactgcccttctgagatcacctcccaaataaactacttgcactcaaatccttgtctcaggctccgcttctgagaaggaacccaaatgaagacagtacacaccacggtgcctttgattctgatgtcactttaacaaaacactcgtgggtctgtttacctagtggaaaaactaggtaacctgtggcggctcccacagatatccagatcctgatccctggaacctgtaaatgttaccttatatggaaaatgggacattgtagatatgattaaattaagaagtttaaaatgaggggatcatcctggattacttgggtggcccctaaatacaaccacaagggtcattataagagacaggcagaggacatttgacacagaatgaggtaatgtgaccactgaagcaagatgctatgctgcttgctttgaaggtggagaaaggggccaggaaccaaagaatgaaagaaatgcagctctagagctggacaaggcaggaaatggatgcttcctgagagccttctgagggagctcggccttggcgacaccttgatttcagacttctgacttccagaaccataatagatgtgtgctgttttaagccactaagtttatgatgatttattacagtagccataggaaactaataaaggaactcagaggtgagctagaacagaggctcttacagcatggtccaccgaccagcagcatcacactcttgggcctcacattagaagtactaaattagaaattcccagggtgtgtctcagtggtctgcagtttaaaaagccctccaggtgatttccatgctggccgtagttcagtgattagccctgcccagacattagaatcacctggaggactttaagcattcccaatgcctgatccaataccccagagattctgatctaattcgtctgctcagcttggactctggactttcataatgcaacctgggtgcatattcttttgtctaaccagggctgggaaccagtgctgtagtttgagactctctgatctagactgttgactttcaaactaagctgtgcagagctttgggattctaggcagatgcagaagaaggggaaggcagaggccaagccagcagggctcctggtcccagagaccagagtcacatgcccagagggggctagagaggtagatgtagtaagggaggtggatgggggttaagagcagacttggtgagctggagaagctccattccagtgatggccagaacgtgcgtccagcagcttgtcctgcttttcaagatgtttgcttctttattttatttaatttttttgctgaatagatatcagaaatactttttgtttttaaatgttaaagcattcaatttttaaatgttagccactaaggcaatttttagaaatcaccaccccccacctttagtactctaagggctaagcataaaggctggatttggtctttgggcagctggttcacaaactccgtctctgtcccacgtgtctttcattcatctcttaggactggataagttctcagagagatgacagaaactccatgtgggtgggatatttttgtctgcttgctcactgctgcatatccccaggcatatagttggcactcatgaaatgtttgttgaattaataaatcctcatagcaattctgtgagacagagactattatatccattcttcagatgagaaacttggggctcactgcatgaaatgagctcttcaccatcacacagttcataaccaagggaggcacaatttgcacccaggacccctcacagtaggggctactgtgaagggaaagacaactgtagttgtgaaagtgctttgtaaaacaagaggcttgtgggaatcattggtgccagtccataggagaaatacaagtggtacttctgactgaattgcatttaaagaagatggggaccaggggcagtggctcatgcctgtaatcccagcactttgggaggctgaggcagacagatcacaaggtcaggagttcgagaccagcctggctaacaaggtgaaaccccgtctctactaaaaatacaaattaactgggcgtggtggtgggagcctgtaatcccagctactccggagactgaggctggagaattgtttgaacccaggaggtggaggttgcagtgagctgagatcgtgccactgcactccagcctgggcaacagggcgagactccgtctcaaaaaaatcaaaataaaaaataaaataaaataaagaaaatgggacacgaggttatttggtgtctcatcgaagccagagcggctctctgttcactctggagctgtgttgtttttgtatggatgtggcagtggtggctgtggatctgaaaaaggaggtgtgagtgtggcaaacagtaaggtggggggttggcccaacttatcagaagggaaagtctcccacctctcacacccacccctctctgtgtctgaacaggacatgagcccactgctgcacgcagaggcttgggatggggttggcaggaagcctgggaccccttagagagttctttaatttaagaatcctctctgattttattatccataggaaatatggggcggtaaatcagaggagatggctggcaagtgcattacggagcattaaacaatagctgatcagcatcagacacaaataaatggtccataatctagtgccaagaatatggatagttcccaagtggtggcctggctggcttccaggcaggggagcacggggctggacatcaggccctacaggccacaaaatgcctgccctgggttacatcccagcaggcaacaggagaagattccagtacccagacagaaatcacatccttccatctgatctcactctacaggactggatttgggtgttctcaccatctggtttctgagacccggacccaaacatcacctgaagagtcctgccttcctggaaaatcctgtattcaatgagggaaaccacatgtgtctgcagggtcatcgatggggatgggtcggctcacaatgcctaaagggaaggcttgtgaagtggattcccctggctccccacccccaaacaccctggttgacaccatttcactagagtattgtttagcttagatccttaacctccattaaaatgcaagaaccatcaaagcagagataaatcagtaccctggcaagtcatgcacactttaatataaagcaatattcaatcttttgctagagctttgggcattgatatactgaggaaaaagcaggagggaatggaaaataaagaatccaggccaggcgtggtggctgtaatcccagcactttgggaggtcaaggccagcggatcacttgaggtcaggagttcgagaccagcctggccaacatggcaaaaccccatctctactaaaaatacaaaaatttgtcaggcttggtggcacgtgcctgtactcctagctactcaagaggcagaggtatgacaatcgcttgaacctggaaggcggagggttgcagtgagccgagatcgcaccactgcactccagcctgggcaacagagcgagaccctgtctcgaaaaaacaaacaaaaaagaatccagaggagagtttccagaggataggagggtagcctacaggactttaaaggccaatatcactatttatccaaaaccataaggagatttggtatatactggtgaaagccctggacttaaagaagcaggatttcagtctccagctctcccacataacagctgcatgaccttgggcaagtcacttaacctttctgagctgccatttcctcatctgaaaggggaagtggtgctgcccccattcaggagtgctgcgagaattacacaaattaaactgtgtggaaggcctgccctccggtaaatatcattgtctttgtgtctgtgcctccacattctggaaattgtactactactgagctaccactgtgggtggatactggagccaagtcaatccacagacccataagtgagtccagccagggccagccaaacccaagctagattagctgaccctcagtttacccacaaacacatgaacttcaacaataaatggttgttgttttgatctaccaagtgtcacggtggtttattacccaccaatggttaacgcaatacaccaaacgtgggaatcttggcatttttaataattgccatgttcaatagaaatcattctaatatataaatggcatttatctaccttcttaagcaagataaagtaggcacaatccagtcatcactggtccattcatgttcatcataatgaaaaccagttaatgtactgtagtcaatgacgccttcaggggttacagacagagcagaggctctagaggtagctctagtctactatgttttgtttgtttttttaaacgaagtttcactcttgttacccaggttggagtgcaatggcgcgatctcagctcactgctacctccgcctcccaggttcaagcaattctcccgcctcagcctcctgagtagctgggattacaggcatgcaccaccacatccagataaatttgtatttttagtagagacagggttttctccatgttggtcaggctggtctcgaactcctgacctcaggtgatccacccacctcagcctcccaaagtgctgggattacaggcgtgagccaccgcgcctggcctactattctttttgaaatctcaggcccatttcctaattctttattgtttttcttgtaatcattcttatcatccgtcattgtgtctagcttaagcagcaactcctccctccccaatttaatatgctatatataatcaccagctttcaagtcacggactatctatgtctattagagtggtgcccaaagtaagagttaataggcttagaataaaggcctgaaatagttttgtgtgtatcaaatattatgtgctttagcgatggcatttctatcatcagttctggcctctgatgttttttgctccttcctggttctcctctgggacccagcagaggaggttgccaggtaatgaacctctgatccagatagctggtgctgcacatggcactgctggaatagtctttcttgaagacagtgaaggagtggattatctatgaaggtaagtactggcttacaggcccatgagagctcttcctccatcacaacccctttccggggcatttaccacacgccacctgtgtttcaaaagcaggtgatcatggaatccctcagagcagaggccacatcctacttgtctccgtgtcccttgaagcacacattagagtgccaggcacacagtaggcactcactaagttataatgcatagaatgaaaagattttcctggttgcccttattttctgtgtatacacagcctatcttcagaagaattaagagtctataagcttctgaatatagaatattttatatcaaactgttggaaaatatttccaaaggattacaaggaacagcttccatttttttaaagcttaagtttatttctgaactgtgctatcataaagccatggtgactaaattaggggggcaaagccaagtgaccaccggagaaaacatatctttgtgatactgagctggttaccttagtgattcccgctaggtctattccattgttttccctaatgtctaatgaccacattcccagccagaagtgcctgtggatgtgcgcactggttgttctccatcccaaccctccccttggctctctgccctcagtgttccagtccctgacctccaggctctgccctctggcttcaagttgggttggccaatgagaggcgctgccaaaaggtgcttggatgggaggagagagaagatggtgtacttctccttcactttctccctgctttagggccttccatgaccaatgctcttgcttaatggccccttctctaaggctccaaatctgcctgggatccattttcctatttgcccctcttgccttttcaagcacagggtggtaaaggcatattgcagttgctaatctctaggtgcctcagcattccttgttggttcccttaaccccgcccacacctctcaaagtgatcccttcattcagatcttttcatctgaaccacctgagttgcttctttatcctgctgttgccctgattggtacagtctgcaaaaagcttacctaagagatatctatgttgtgccagggtgctctccaaggcaaagagttcaaaagaaaaccagaggttcttttctctctagttttctgaactccttaaccactttggtgctatttaaattaagtaatacaaaatgatggtaaaccccagtttgcagatgagaagcttttattcattcattcatcaaatatttattgattactatgtgccaggcactgttctgaccctgggaaaacagtaaagtacaagagagacacatgccctggccacatggtgcttatagtgtaaggccactgtctctcagaagtcagggagctcatcagaggcagggctagaaccagaaaactgagtttccttaagtcctaaccttcagcagattctcaaaggaatccatgacccaaacatgattaagaaccaccaaattaggccaaattaactctcaagcttctcccttgaactggggaatgaataatgactactcactcctagaagaagcttgatgctcttaacttgaatttgcaggggcatgtgggcacacacccacggtgacaccaccactcacctttcctgcccaccctcctgaattctccacaaatctgcccccacctccttctgtttctcacacttttataattagcctcacaccagtctctgagtcactccctcatggcccacaaacgttggctacacaacttgctgatgagctgtttttatcaatggacagcagttgggagctggattcagagatgtgccctctctgagagcctggcatttctggccctccctgtgtttccagcaaaggcagcgatagtgaaatttctgtctcagttgaagtatttatgagactcatgttggaggcataactaaaactttgctggggagagtcaggggtcactgaggtgaattgaggggggctgtgagggtctgcctgcctccttcaagccctccggaaacatttgagtttcctcagaaaggtttaaataggccatactagtaaccgaatacttcccctgctctgggtcagacaagacaagggcaacaggctgctgacctcagaaaaggttgcaggctggcagacacagccccttccccaaatctcccagcctcatacccggcagacacactcagctccagacctggctgtcactgtggaaccccctccacttctccctggaaagctcacttctctcaggacctccagctgccttgtctgaggctgaagggaagtcgcacccaggaagacaggtctggagaaagggaaaacctagtcctgaggctgcaactgccccgccgctgttcaccccccaccccaccggcccctgccacctgcattttcccttcgagggactattgtggccatggatgctatctgggtctggaaagaggtttgtttactccacaacagcccctgtgaggcaagcccccttcgaagaggtcagagatgtatttatagaaacatctgagactcacttctctattacttgcacacctctgtctcttttaagctctcccaaattcctgaccaagatgaaatcatgcagcaaatggggagaataggggaggcagaaaccatttttcaaagtgtctctgctttgagcagccaggtaggagccggttggaacaaggacagaaggggcttccgagacaagctcgggtgacaggaagctgctggggtggccgtcttccttccaacctccctccaccaacagttgaatggcaaaaacatcaggacacattgcaaaacaatcttccttcctccccctgtcccctgacagatggaagagaggaaagttgtggccatcatttacctgctgagattggaagaacgctgttgatgaaagtcggctgagacacgatagagaggaagaaaagctgaagataaattcccaaagtcattggattcaggacaaccatgctggccagggtctggcgagggtcaagttagaaaggaggctgctgcggagccttgcttatctctgcttttctcttcctcactgctgtttgcgtgcgcgtgtgtttgtgtgtgtgtgtgtgcgtgtgtgtgtgtgtctgtgtgtgtgtgtgtctttccctctttctctttccctctccctcctcctcaccccctccctctctctccctcccccacctctcctgtctcccatgcctttaccaagaaagaatgccaaccatatcccattaaactgtctccatgctacagagagttatatttatctcaagctccatatcaaatgcccacattaaaattaagatgtcaaaattttcttttttggagactgaggtaagtggctagtgaagaggtgatgagaaggcagccaagtctcagatgttcactggaggcagtcctcaagggcagagagattcctaattggttatgtgccaccatctacctccttggaactgggcagaaacaactctcctgattcaaactgaatttcatggagaaaaacccctccactgtcagcctgtgacatttttacccattgtgtaacaaatgtaaagttaacttttaatttttttctttaatcatccaataaaaaggaggaaggaagtagtttatatttccaaacagctttctctgtgaaaaagtgtttctctctccaaaagctgcaaccttttgattcaatgcaaggcaaaataaatgaaaacagtaaaagtatagaaaagtgaatgatttttatcaaactatattcagaaaaataacatcactaacttaatctttggctagacaaaattattcaaataaaaattatcacattcttaataccttttatgagtttataaaagcctgttatagagatgattagatgactaaaacaaaataataattcacagagttgttcattttgctttaatttacatattacatgcctcataggagttaactcagaaacagtctgctagttactggatgctggggtgggcatcctgcccctgtgctcattatggggaaggtggagttgggtcagggcgtggtataaagtgatattttacagctgtagcaccacacttgggcttgactctcagctctgagtggcagtggacaagctcacctctctaagcctcagttttctcatccatacaatggagacaatgttccctttaaaggtttgttggaaagttaagtgaggtaatggggatgaatcctacacggattagaacttgcacataggaacagcacaaaggagacccaagggagccatggtagcctgggtgcaaagatggcctccaaaagtcctcccaacccagtgtgtgcatgacactcttcccagcaaaaagcagggctagttcccctcccttaaatctgaggtggctctgtgacttactttgaccaatagaatgtggctaaagggacactgtgccatctcctggcctaggccttaaaaggcctggcagctcctgcttttgccttttcttgaaaatcagctgccactttaaaaagtctggactattgaagaggccacatggagggggaagcagccagcctccagctgttctgactatcccagatgcagcatcaacaggcgagtgaggccattttggaacatctagccctgtcctggtctcagatgatgccagccacaggagtgaccccaagtgagaccctcgaaagaactgcccagcccagattacgaagtcatgagcaaataaaacggctattgtttcaaaccagtaagttttaggatgacttgctcatcagcaatagctaactgatacagagttgataaggaaagcttttgaaagcatgaaaaatatacctgaactacattcaaaatttataggacagattaaagagagggtacccccatttagctgctcccaaaatttttacaagaaggagctgtgattgctggccaaactcaatcaggacattctcaggctcactcttgttaactcctggagccccagcagccagcttccagtggcttggagaaggtacagtctacctgggaggaaggtatcttttgagtaacttggtgtcagaatatgaatttttactatctagctcagattcctcctctgcaaagccagtatgacttcttccttctctcagcacaaagaattcaccactgaccatacccttggaacaaattctgtcaatacgtcctaccggtgacacctgctgctattgtttttgaacaccaccttgtgttgctatttagctggcattaacatccctaaagataggggactatcccacagctctatgtactctcaaggcccccaggacagtccttgtcacctaacagatcctcaacaatgtaagttactttgatcaaatcacaccactgggtaggatgaaaaaagaagaacgtacaaaagtagcataactttatgctccagctttctgcacaacttgcatttccccagcaccccttggagcctctgcacatacagctgggtggcctgcgcctgatacaagggagggctttggtgagtatggtgagagtgtgagagggactatggatggccaccttgaattaggacccgcagacagagaggctaaatttataattcaagtcactggagaatgagtcactgctgatctaaagttacgacaggagcctctaccctttgaggaggccccaacacagagttatttataaggccccaatacttattaaacaatttttagtaaatttccatttccttaggtatcttatattttatgaacctatttcttataagattaccctaactgaccaagacagaaattatcatctttcttcaaatcctcctggaagggctctgatgtttccagaatctaataacatagactattagatttgtccagaaggaaactatttgagatttgagaaaagctcacaccaataaagccattcaaagtcagagtcttccctctcagaccttgtaggcaggactgtacactggaaaacaatcttttggccccattaaacttaaaatgcacatgccgtctgacccagaagttctcagaaatactcattcactacccagtggtttaggtgcaagggtgtgcattgttgcctcaagttggaaacagcctaactgtccatgaatgaaacattggtggaataaatcctgggacatccattcaaaatgttatgcagtgactagaaagaataaggcagtctttgcaacaaatggtgctggaaaaatttgacttccatatgcaaaacaaacaaataaaaataaagattaacccttaccttgccccatgcatacaaattattttaaaatagaccacagacctaattgtaaatgctaaaatattaaacttacggcagaaaacaggagaaaatcttagtgaccctgggttaggtacagattttttaaataagatgcaaaatacaaatcttaaatttaaaaaagttaaattggacattataaaaactttaatgcttctgctcttcaaaatagaatactaaattggaaagccaagccaaaaactaggacgtaatatttgccaaacacatatatgataaatgatttgtagctagaatatattaaaactttcacagctcaataataataagataaaaaacttaattaaaagaaatggcaggccagacatggctcacacctgtaatctcagcaccctgggaagccaaggtgggtggattacctgaggccaggagtttgagaccagcctggccaacatggtgaaaccccatctcaacacaaaatacaaaaattagctgggtgtggtggcacacaccagtaatcccaggtactcaggaggctgaggcacaagaattgcttgaacctgggaagcagaggttgcagtgagctgggctcacaccactgccctccaccctgggcaacagagcaagactctgtttcaaaaaaaaaaaactgaaatgaaataaagaaatggacacagcctggacaacatggcaaaaccctgtatctatgaaaaaaaaacaaaaaacaaaaaacaaaaaacagaactagctgggtgtggtggtgcatgcctgtagtcctagctacctgggagggtgaagataagggatcacctgagcccaggaggtcaaggctgcagtgagccattactgcgtcactccagcctgggcgacagaatgagaccctgtctcaaaaaagggagggaaggaaggagggaagaagggaaggaaggaaggcaaaagatgcgaatatatatttcaccaaagaagatacattaatgacaaataaacatttgtaaagatacccaacatctttagtcattagggaaatgcaaattaaaaccacagtgagataccactacacacctactagaatagctaaaatttaaaagactgacaataccaagtgttggtgaggatatgaagcaactggaattctcaaacattgctagtgggaatgcaaaatggtgtaaccactttggaaaaaaatgtcagttttttataaagtcaaatatacacttattatacatccaacaattctactcttcagtatttatccaagagaaatgaaacacatgtccacagaaagactgtacatgaaagttcataaccacttcatttgtaatagctaaaactagaaacaacccaaatggccatcaaccagtgaatggataaacaaactgcatgtgtacatacaatgcaaaactactcagcaataaaatggaataaactaagtaacatggaagaatctcaagtgcattatgctaagtgaaggatgccagacacaacaggctacatactgtataattccattagtaggacattctggaaaaggcaaaactatggggctggagaacagatccatggtgccaggggttagaattgtgagaagagaagggggcccaagagaactagcagtgatgaaaatattctttatcttgattagagtggttgtatattttgtcaaaattcatcaaaccgtactctcaaaaagggtcagttttattatatgtacattttccatcagtaaacttgactttaaaaaataagaaaaatgtcacatgtatgcactgacatggaagattgtcaatggaacactgtcgagtgaaataagaaagtggcagtatatccgaccaaatttctgaacaaacaagcaaatctctttatcagtttttatatgtgcgtagagaaagatctagaatgatgtacatcccacagtatatgggataagagaagataaaaggagaattcccttttcaagcttatacatatttgtattaaaatttttacaatgagctttatttaacttgtaatttaaaaacaaaattctatttttacaaaatcaagttagggcggccttaggagtaaagaaaacagcagaaaggaaaaaggcgccaatcctgcatgcccgaggtccaacaagtcttttgcagacgtgttgtgaagagcagagagttattgattggtcctggcagagaaacagagctctgagcctggtctctctggcccagaatggatgatacttcagttatgcagaggtcatagccacctcccaccagcaggcgggaggcaagcctgggcaactgagaagccccaggaaagcccctcctcacagctcactgttccctggcaacttggtcttaaatcaaagccagaactgatggggcctgggaatgcaaagcatagcttcatcagagggccagaagagctaacgagtctgataagacccattagacttatccaggcatctcgcccatagttacatctccagggccaggagcttagatttcctcactttcagggcaaagatagtaggctggccttgagccatctggagtgcaatcacaacactagcgacagtaatcttaaccaatacagtgtttttcatactatgctggggggtgtgctcattctgagatgcatggtttttgaaaagcagaggagttcatggacattaggaaaccctgcctgttttatgtcactgttggaaattcacaacatttattggcatatcaaaaacactgagaagtccggcagtaaagaaatgcattgactttgcttttaccccaaacatatttgaccctcaaacccatttttatttaattcttattatttagctccccacttttctcttatctacatgttatacactaaacatgttactggtatgataaataatcgtatatagggctttattttgtatgaaatccttatctttttttcattcgatagtcataagtgaggcagcaagactagaattataattcccatcttacagatgagaaaactgaggcttatgtgaagttctggggacagcagcagaggttcaggtcattggctggctggaacaatgcctagcaagactagatatgaagcgtgcaggctgctgaatgacacatcgaatcagatgtcaccagtgctctagcctttagggctagacatgttctccatggaacaccaatcaacctgtctttacctgaaaccagactcagaaaggttgtgagtccaagaatcattcaactctgaggatgcaaaaccacattcttggtagggagacaggacataagggaaggccagggacttccgaggagaccccaaaatgctttatgacaacccgaggattgatggttcttgaactaaagcccataggaaggaaaaacatcctgaatcctgaacaaataaatcctaacgttatttatttcaagaatcataggaataagtaagctcataatatttagtaagccaccaaagggcgaaacaaatctgcctcgctctttcaggtggagcttgccccagatttcccctaaggtgaaccctgggaaacttaggtgacattcactgcgaactctctagccagttcaaatgcatattcctagtatactatttgtacttaacacaagctaattgcaaatttttatttttatatatttattgaaataatattaccacccacaatcccatcacctcccccaacaccctcagcccatcaccggccccctaccccaatcccagtccccaaccacaccaccttgcctcctggagagatggttcctcttgcatttgaggagattggatggggtggggaggaaggcccacctagcaacttgatttggcccaaagccattttcaaagcttggatcttgtctctgcccagctaaaggtggagatcaagggcatgtggctgtgtttggcaaaacctttaataacaataggctaatgctgaccaagactgagaagtaaagggtaagaaagggaaccactcttactgcatataattatgcatcctgcatcccagttatgagaagagagagcttagccaatatgcgcaataatcaggcactgctagggagtatcgtagagtcacctactagctgaggctggctgtgtaggaaataatctcctcagagatggacaagaacatacataggcacccacgctgctccaatgaagccttacaatccctgtgacaaggaggttcctcccatcctgcaggttgtagtacaagtcgcacaaacctgaggtcacagtatgttctgtatttaatccacttaaggccttaaagtgctttaaaaatactcagccacagggaaagggttatctccaaggccaaaatgtaaacatatgcaatctcaggtaagaggaacaggtgatttttttttaagtacaagagagattaaaaattttccacccagttatcatggattatgtggcaatctgtttccttatataaagagttactaaatgtaactgtgaagttttaaaaccacaagagtgtcctcaggaagtagatgaacaaggttaaactagagaagacagaaacagaaaagcaatgattcaggaaggtaagagagaggtcagagaattcattcactcattatttttctgttttcctgttatttatttatttatttattttggagacagagtctcactttgccacccaggctggagtgcagtggcacaatctcaactcactgcaacctctgcctcccatgttcaagacattcttgtgcctcactttccgagtagctgggattacaaatgtgcacctccatgcccggcacatttttttgtgtatttaggagagacggggtttcaccatgttggccagctggtactgaactcctggcctcatgtgatccacctgcctcggcttcccaaagtgctgggattataggcgtgagccaccatgcctggcccattattttttcattcaataaatatttactgtgttcctatcacaacacaggccaagatctacaagctgtagattcagcatgcacagagtgtacaaaagtccctgcccttgggaacttacattctaaggaggtctcaagacagaagcacactggtgttcagtgtaatgtagaataatggagagaaataattgatcatggagagcctccctgaggaggtgacatcggagcagagacctgagaaaacgagccatgcagatatctgggaggaaagcattctaaggcatcaggtgcaaacatcctaaggcaccaacaagcttggtttttccaggaggagcagaatggagttacacgtggctcgagcagagtaagcaagagggagagtgaaggaaataggatccaagaagccactggggtcaggtcatgtggcatttgtaggccacgcatggagtttggactttgttttaagatggaagtcagtggagggttttgaacaggagtggcagctctgatttgtgttgtaacaggatcacccctggcttcaccacagtagattgtagggggaagtaggaggcctaacaggaggacactgaaggtggagatgatggttggttttccaagaagtgacaatggaggtggtgagtaatgatcagattggatagatatttaaggtcgtgtagcagattgtattttccaaagtctgcagcgccaccaaataccccaccctcccctgtcttcttctgatggaatgttgttgcttctccttgagaggtggtgtgtgttttccttctctgaaccctggctccttcccctcccaattctctgcacctctattgttttccaggtcacactcaccccaacctgacacctccttctccccagcctccaggcctttattaaagttaccagaacacagaaagggcttgcagtgagcagccttctcacagacacaggtgcaggtgccaggcttggcttctaggctagcgtacgacaacacagggatgggacggggagaaaagtctttcctgagacgctgcagaaatctggagaggacttagcgtgatcagagctatggaactggggtcagtggtgatctgggaggcttgactgccatctgagttacaggaatttggaaggagtgccagagtcgatgaggaaggtaagagatgaactttaattgtagttctctgggaagtattcacggaatagtcatttctgaccttaagggatgaaaataccaactacaaccaccaatcattaaatacctatgatattcctacagatgtgatttcttggaagcctctaggcttttgagctaactctatgagatgggtattactctctctatggatagaggttgacaaaggtagcttaggtaatctgctcaaggccacagagctagaacacaaagctggcccacatacctcaaagcctgtattctttacaccacactacccagctccaggaccagacacagtagggaaatggggagacaggtgagtgaactgccccaccccagggcacagtgtgggcatgatcatggcccttttgggggcagtggcagggcctcttggctgggagcccttgaagagaaatagaatgaggtatgcttggatgatagactgctgacagattctggtggctcagcatagcagaagaccacttccaaatttggacggctggacagtgggggaacattttatttgggcttattgcactccagctcctgctcctgctgggaactgctagcaaggacagcttgccctgtgttttccctggcctgacatcctattccagaatccctgcactttctccacctggaaagcctcctgtccccatcccttcatgtccaaatcctcccagctctcccaaatttaaatgtttccccctcaacaaagcctttgccaggagaaatgtgttccctctgggaacttgcctagttcatgctctgcttttcttccttggcactccttgggcagcgggcttgagggcaagagcaccatggtttaaagcagacagtacctgttttgatacctggctctgccactcattagctaggaaactcttcagagttcctctgaaggaatccttctggggtttcgataaagtgtcagagattactgctgaggctccttggacaacgactatccagatctcaggactcagccctcctccctccttccttcaggacccctaactagggaagctccatgtaagccttagcagccaaatggaaatgggaggtcaccttttaataatagtggtaacaaccaaacaggttctgctaaagttggagaatgtgggttaggcctggagaccacagagaattgcctgcttcctccccatggaatctaagatggccagctcctctttgggctcctgtctgcctcccctccagggatagggaggagagaggtggcacacagagtccagatctgggtaagcagctgctaggaagcctcctgaccataagcatgagacaaaggtagcccatgccacggtgctgatcattatggtggggtgacacccacccatgagtaaaatgacccaaagagtgtccttggttctgatcaatctaactgataactccttttttttcttgtagggcatgggagcatggacttagatggtggtagcccaggcagaaatgtggggaaaggcgtctcctcttcaacagtatggattagacacacagcatctaaaataccttataaaggagcatggtggctcacgactgtaatcccagcaagttgggaggcaaatatgggtggatcacctgaggtcaggagttcaagaccagcctggccaacatggcaaaaccccgtctctagtaataatacaaaaattagctgggtgtggtggcatatgcctgtaatcccagctacttgggaggctgaggccagagaattgcttgaacctgggaggcggagcttgcagtgagctgagatcataccactgcacttcagattgggcaatagagtgagacttcatctcaaaaaaacaaacaaacaaaaaaccttatagaatgtcttgccatgtggcaggagtgatctaaactattccaaaatatgaatattgaggtttgcgtgtatgtatatgtgtaaatgtaaatgaagctctagtctgttctttcaaccttgcaatataattgtcttggtctgtttgggatgctataacagaatatctttccctgggtggcttataaacaacagagatttatttatcacagctctgggaagtccaagatcaaggtggtggcagatttggtgtctggagaaagctcatttcttggttcatagatggcagtcttctctctgtgtcctcaacatggcagaaacaaggggtctctctgagacttcttttttaaaggcactcatcccattcataaaggctctaaactcatgacttaatcgcgtcccaaaggccctatctcctaataccatcacttggggattaagtttcaacatatgaatttgggggggaacacaaatgtttggtctatagccgtaattatttaggtatgtgctttatttctctaagtagattattaattcttgagcacaaggcccttgctgctttatctctttattcctccaggtgccaaatctgattcacagaaggcattcaatagtgttgaatgaattaatgagttgatttgcatgacgcatgcaagttagacaaactacactgcatatatctagaaccttaaaagtaattcaggccaggcgcggtggctcatgcctgtaatcccagcactttgggaagtggaagcaggcggatcatttgagatcaggagttcgaaaccagcctggccaacatggtgaaaccccatctctactaaaaatacaaaaattagctgggcatggtggtgggcgcctataatcccagctacttgggaggctaaggcaggagaattgcttgagcctgggaggcaggggttgcagtgatccattgtactccagactgggtgacagagtgagactccgtctcaaaaaaaaaaaaaaaaaaaaagctaattcagcctggatcaagtttccctttataaagtctcagaacagatgtggttcttgccaagagaatcatgggtttgcagccccacgggcctttgctttaaatggaatgacacatggaaggcaccttgcacaagtctggcccaggaatgtgaggttccagggccctctgtgtgagccggcagctgggtgagtgccttgatgcccacctgcctcccccagtctctctccacaatatgccagacatctcccatatcagggatgtcacctagcctgggacaaaagaaccagctctcctcagctctggcttcaggaagtgccaggtcattgatccttgaaaaaaatagtcttcagatgggaagatgctgacatgatgacataaccccaatgacagcctgtgattctccacacactgcctggaaaatgcattagccaagtgtattagtttgctagggctgccataataaaaagtaccccctgctgggcagcttaaacgacagaaatttatttctcacagttcagggggccagaagtccaagatcaacatgcagacagagttggtttcttctctgacttctctctttggcttgcagatggtcacattcttgctgtgtcatcgagtggtcttacctgtgtgtacacattcctggtgcctcatgtgtccaaattgcctcctcttataaggacaccaattggattggattggggcccactctcatgatcttattttatcctaaccactttttttttttttttttttttttgagacggagtcttgttctgtcgcccaggctggagtgcagtggtgttatctcagctcactgcaacctccgcctcccaggttcaagcgattctcctgcatcagcctcctgagtagatgggattacaggcatgcgccaccactcccggataattttctttgtatttttagtagagacgggatttcaccatattggtcaggctggtctcgaactcctgacttcatgatccatttgccttggcctcccaaagtgctgggattacaggtgtgagccactgcgcccggcctatcctaaccacttcttaaagacccaatctccagatacagtcatacctgaagtactagaggttagggcttcaacacatgaatttggagaagacacatttcagcccgtaacacccagcttaactggtttcagctgtggaagaaagcacacatctctggggtcagaaggacctgaatttaagtccatttatttcccagctatatgatcatgggcaagttgttaaacctgtctgagtttttgcttcctcatttgcaaactggagttcctgggtttgtgagaatcaaaggaatggtcatgtggaaagtttcccccttagcccactatgggaatgtttggactcgaatacacatggcaacttgctgatggagccctggggaagagaggggaggagggaggagtgctcatggctccctttagccctgccctagcctaaggagaaagaaggccgctatggagcagatgcattaaggacatcttccctactcctgtgctggtggggggcgtcactgtgccaggcacaggaaatggatcaggttttaggctacctattatcaggcacatagagacagccagtacctctctttaggtagagacctcccttgctatttgaattgaatgagaagttttgatatagacacggctggactttctaacgcttgaaaatgagatatctggttaatagctgaaacgaacagcgaaagctatgattcctgcttaaactataacccaaaatctgggaaagggagatgtgataaagctcttttaagagccccaaactttcaataaactagttatcagtacttcttatttcttgtctcattggtatcttatatccctaatccttcttcaaagcaccaaaaattcagatcttccaacttttgccacaatacaagggtcaagccaaagcactctcctaattgagttatcccctttgaataaaatcttacatctcacttgatttttaccatttgtcccacaaaaaatcccaaacctcttataaagtgatctttaaaaagcatgttaaaatgtaatacagactgaaactgagggctccagtgcaagtgtgggtggggagaggcagcagagggtggagacaggcaatatgagtcaggctgcaggaggatgcaatgagctcagtctctgcagttacctgaagagttagctggggctggaggatttcagaaacctggacttctttatagggcttcatgactgtcttcaggacatgtcaaatggcttacccaagagcaagcgatccaagaggaatataaaggaaaatgcctccaggcgtccaggccacactcaaggagagaattaagcttcaccacttgaaggaaggagtaccaatgaatctgtagacatatttcaaaaccatcactttctcccattcatctgcttttcttgagtcaaacttgtgtacaccaaggttctccttccttagagtgacttccttctcataaggctccctagttcgttatgcaaatgaatcctagcatcctctctgccagctccccgaatttgtaggggcacacagtctttatcctagcccagcacacttgcttttgtatgccatcgtggcccagaacaaacttacaccgaaactccacttccctatccttttgaccatcctgtgcctcaggaatgaggccaaacatccatgtacacctgcatagaagaaaaatgggccaatttttcttcttagacacctacaactaaaaacatatcacccagtgggtaagcagagaggtcaaatcttagcatgcatcaggtcactcagagaatgttttaaaacaaagattttcaagtttctaactcagaaagtcttgggagttgggtgcggatttccatttcttatgtttccagatgatgctcctgctgctcgtccatgggccacactgcgagaatcactggtataagggttaattgagtgaaatgaatgcacctacagtgattgaattattggggcacatttatccaggtggccattttcagcagggtaatttggacaaacttacaacttccctggaatattatgttttgtggctatgttcttctggtctcttatctccttcctatgttcttccccttccattaaatatatccaccctaaaagcatatataacctattttttcttttagatttttgtttataactgcctttcactttattggtacacaaattctgagaactgacgccttggaggaagccctgtggtttgcaaattcaaaaacacattttgaattgaggccaacttaaaagcatatctcattacttttttttggattttcttacgtgctccaactttccattacatttctcccctttcctatcagtttgaatctgcaaagtacttgacttaggaacttcacaaactcaaagcaactaacaaatggtagcatctaatatgcaaatgaccttctaaagtaattttctgtttttattctgctctatttcagtcagtctgggagatttctggaaagagcctgttctaaaagcatttccatttatattagtaactggctccataaatagccaatttgttttacttttctctggatcattctcaaccctatttgttccagttgagtcaaattgtcaaagaaagctgaatggtttatattcctgatgtacaatttttaacatatttgcaagaaaaggaaaaagaaaactacaccagcatataacattgtttttattgataacctctctctccagccagctagtaatctatttctattaaaaatggagtctggcttttaaaaataatgaatgctggcagggtgcagtggcttatgcctgtaatcccaatactttgggaggctgaggtgggtggattgtttggggccaggagttcaagaccagcctggccaaatggcaaaaccccatctctactaaaaacacaaaaatcagatgggtgtggtggtgcacatctgtagtcccagctactcaggaggcttaggcagaagaatcacttgaacccaggaggtggagactgcagtgagctgatcatgctactgcactccagcctggacaacagagcaagactctgtctcaataataataataataaataatgaatgctgttgatagtggggaaggctatgcctgtatggaaaccagaggtgtatgagatatctctgtaccttcctctcaattttgctgtgaacttaaaactgctctttaaaaaataaagtcttttaaaacatgaatgtaaagtgtttattgcataatgacttaatggcaggatgaagatatattaaaatatccattgggaagaaattttcaaagatcccaataccaaagtctttggtgagcactttcatcccactggctggaactcatcaaagctccctcctgttgtgttgagttccgtgttgccacgactctgaggaggagattcagatgcacacctcatgcacactgccacgttattgttgcttaggtgctagatgtctcccctaagtggtcactgttcagcgccctgaagcctgtgtccctggagaagcccacctcacatctcctacaatttgaggagcaccatctcccctgctttctcttatttatcaatctcactgaatcaaatctcagccaatagtttgtctggtcgcccctttagctgttctgtgggaactgtgtctagtgtcttttctcagatgagcaatctagaggctcacatcttgctacacacaaggttagcaaagtgcatggcacacaacggtgactcagtagaagctgaatgatataaaagagttatgatctatctctttaccactttatcactgctcctccttgtactttgacattgcttgttctttaggtaatcctcagttttgtcacctaaatattaagcccagaattttgcaagaagatcaaaatggaaaaaattcaaaagttctcaacttaaaaacacagccccatttattctcttttgaatcttttctcttttaaaattgcactcttcaagataaaaccacaccatatgcgaccctgaaaaagccacttaatttccctgagcctctttccttacctggggaataataccactccctccaaaaggtttctgtgaagaatgaaataaaattatgtgtatgaaccctcctaagagttatgtaaacttgattatcattattccctcaaatctagatcaaaacaataccagtaagcaacattgacagttacctaaaacagaacattagccattttctcttccatgttttcttattattttcctgaagtcctccattccttgggtcatctcagggagtggatgggtcagccaagtctggggaatccctgaacagaagagaccattgcctgactttccagagtgtggaccccaaggagaagcccatgcccaacatggcatccagtggcagcattccagcgtctgagggagaagtccaggcagatgggcctgagagacctgcagagatctgtacatcccagcatagcatgaggaatgatgccagaaacttcccatgtccccatgggaaggggctgagcagatggcaaactggaaaagtcctgtttgcaaagagtagatccattagcaaattagaagtggagcctcaggatgggaactccatgaggagaggggacaattatagtagctggtctccaaagatggcccccagtcaaccacacctcccaggggtcacattcctgtgtagtcccctcccacactgaacctcacttggtcctgtcatttgctgtaaccattagaatgcagcagaagtgatactgtgccagttccaggcctggcagcttttacttttgccctcatgagaaaaaccaggtacccttctggagagagaccacatggaggagtaccaaggggccacagttgtcctggaccaatcagcttaaggctgtcagaaacaaataagaagtctaacaaaatcaggtttattcatccattgcaatgagggagacagcagcccagaggaaccgtggggcagctcaccaaacaaatgtaaagtagagttagtacaggatttagggaaaaggtggaatttaaatgaagtagatttttttctgcttgtttttgaactgaaaaattgttctataaattgaagtcatcaaggaaactcaaaagtgacattaagagtcaaacaattttcacacaaagcatttgaagaatatatgtgcattatatagatgagaagggggctcaagaaaaatgagtagggggcagccgcggtggctcatgcctgtaatcccagaactttgagagaccgaggcaggtggatcacttgagaccaggagtttgagaccagcctggacaacatagtgaaacccagtctctacaaaaaatacaaaaattgtctgggcacggtggcacatgcctgtagttccagctactcaggaggctgatgtggcagggtcacttgagcctgggaggtggaggttgcagtgagctgagattgtgccactgcactccagcctggacaacagagcgagatccaatctcgacaaaaaaaaaaaaataataaaataaaaggatgagatgggtatagaccagagggtgagggatgaggggcatgagggaaccttaggtatgctagcccggttacacactgaagcaatggagatctgctgggagccgactaataagaataagacaatactggcccaggaagtgccaacagatgcaaagccatatacaacattcaaagtcttttaatgtctgtcattttaacaaattgagatgccatattccacagaccataaattcacgtaagtcaccattttagactatacaattcactgatttttagtattgaatctgagtgttgatggtctcaaagcaaagcaggctctgtgtaaaggtttcaacatcaggtctggactatgacggaaatgccaaggtcctcctgcttccttgtatgttagaaagctatggcagatgtagaatgttgtgtccagaaaaccctctgcatctgagttgcaaattaaaactgtttctctgtgccaaagtgacttagctcctccaggcacggagtatgtcattcttacttataaaagtttctaataatctatgattttagaaaacaaagcttctcactgaataagaaaggcagctgttagccacttatagctgcagtgtgcctcgggatgaaaaatttcctcctgttaacttcacatctggctttatccatgtattagtccattctcacactgctataaagaaatacctgagactgggtaatatataaagaaaaaaggtttaattggctagtggttctgtaggctgtagaggaagcatggatgctgccatcttcctggcttctgggaaggcctaaggaaacctattacggtgaaggggaagtagacgtgtcttacgtggccagagcaggaggaagagagagtgggggcaccacacacttttaaacaaccagatttcacgataattcactcactcaccatcatgtgaacagcaccaaggggatggtgctaatccatttatgagaactctgccccaatgagccaatcacctcccaccatctgcaccatgggagattacaattcgacatgagatttggtggagacacagattcaaatcatgtcaatctgcatctgttattccagcctgatgcctatttaggcagattttttttttttttttacattcttagcccaagctcatttttattttctcagagtgaagaaggcaggcaactcaggccttccagcccagtgctgtcctccagaggatccggctttagctgccatctgcccacagctgcataagacagctcaagcaggataagccgaaccactgaatccagtcaaccaacaaaatatgagagaataatgtcttggatttagtcactctggtttgggatggtttattgcgtatacacagattaaagaatcagtcattcttgaagaagaactctcccctgatggcaggatggtaataaggcccctgaaaattagatcgtccccagagaagaagaaaacaagggagaggaatgagcctaaattaaagacttactcaaaagagacttgagttttaacctctactgatagaagtcagaagagtaatggctgtgggggatgcatgggttggctggagggggcatgagggagccttctggattattggcaatgccctataccttgatctgggtggtggttacatggccacatacatatgaaaaattcaccgagctgtacacttaaatactaagtggaaatggagttcaggagctaatttctattatagagtaataaagaaaagttcaccaattctgtgaaatgtacacctgccacaacataagtgaaaacaaagaatggcagacacatgaagtaaacaaatatttatatagaaaaaaagtattatttatgaatctaaacagtgagtgaccaagatgccaaacagaaacatgattaagaacagggaacttgagaatataaaattataacattgctggaatactcattcttgtaactcctatttcaatgagttaaattagaagtagactatacccttttcaagatcatcatccctggaattagagatggaaggaagctttgaaatcctccttcactggttccaaaactgggctgcacactggaatcacctggagagctttaaaaaatactgatgcctggggcccactctagagattctgatgtaattggtctgaggtgtggcttgggaatcaggatttttaaaagctccccaggtgatttcaatgtgccgccagggttgagaattatgggtcaatttcaaccactcttctcacaaatgagaacacagaggcccaggactggcaaatggtttgctaaatatccattaattggctgcagccaattttctctgatgtgctctaataggagggagctgtggtatggacaataccaaacaatgaataatctaaaaataatttatatttggttcgggaaagcagcacatgacttcctggctgccgactggcctggctaattcagttgggtcgaaatgaatgtgctctttcctgcactgacactgacaacccagctctgtgctgagatgtggaaggaaggtggccaaattaaacaccggctgcagccagttctccagtgggcaacagacatggtgtcaatggcacatagtaacaatatggatgtagggacttgtctaacagaggattccacgatggagcaaagctagctttctcctcatcctatactctaagagggagggggaccagaggcataaagacggaacgaaggaagaggggcttatgtttttcaaggagctatttggtgccaggtttcataataagcatttctataaacagcatatggtcttagctctatagagttaggcattctggaacccacattatagagatgaggaaactgaggttcagagaggttgtataacccaaagcagagccagaatagaaactccagcttaccacactcaacactttccgacataccatctgtctgtcgaagagggagagatgcagatggacttgggtcagatccttagattgtaagtgctgctaagcaaacttcacctcccgatttttcagttctaacagtctaaaggcagcaacaaagagacctccagaaagtacctgtgcagccatgagaatctgtctccaatcacgggagcataactgaccaagagccccagctgccactctctgaaatctgtcacccacatttacgctaaggccacatttcccaggcattgtgctgctcctctccaatgtccagtagaaatatgaaggtggccctgttcctgggaggcatgggactcctctgataaaagtcttgccaaattctcctcagatggcacccagccaggatgcttctgcccatccttcctaccctctttcctcattgaggtctgacctgcattgcagtctgatggctctcagccttttccagctcttctgttttctctcacagaggcatttcccttaataaagtccctcatgtatttaatcctaccttggcatctactttccagaggacctggacaacagaaatgcccctagctaatggtgcccccaactatacacacatcacagtggggaaggcgaggagagaaaaggtcatctgctgactcatcaaggggaagctggtctgaaattttttaataaaattgtgggtacacaggtgtataaatttatggagtacacaagatattttgatacaggcatacaatgcataataatcacatcagtgtaaatagggtatccatcaccacacatatttatccttctttgttgttgttgtgacaaacgatccaattatactctttgggttattgtaaaatgtacaattgttgactacagtcatcctgttgtgctgtcaaatactaggtcttattcattctttttattcttctgtacccattaaccatccccactgccctctctcctgactactgttgccagcctctggtaacctctctatgtccatgagttcgattgttttaacttttagctcccaccaataagtgagaacatgtgaagtttgtctttctgtgcctggcttatttcacttaacataatgacctccaattccatccatgttgctgcaaatgaaaggatctcattctttttatggctgaatagtactccattgtgtatatgtaccacattttctttatccatccatctgctgatggacacttaggttgtttccagaacttggctactgtgaacagtgctacaataaacatgggagtgcagatactgcttcaatatactgatttttcttttgggtataagcctaggagtgggttgctggatcatattgtagctctatttttagtgggtttttttttttttttttttttttttttttgagacatggtcttgctctgtcacctaggctggagagcagtggcacactctcggctcaccatagcctctacctcttgggctcaagcaatcccccatccttagtctcccgagtagttgggactataggcatatacaatcatgcctggctaattttttatttttgtatttttgtagagatggggctttgccatatttcccaggctggtctaaacacctgagctgaagcgatccaccctcctcagcctcccaaagtgctgacattacaggtgtgagccactgtgcccggccctctattttcagttttttgaggaacctccaaactgctctccatagtggttgtactaatttatattccaccaacagtgtacaagagttcccttttctccacatcctctccagcatttgttattgcctgtcttttgaataaaagccattttaactggggtgagaaagcatctcattgcagttttcatatgcatttctctgatgaccatatttagcaccttttcatatacctgtttcccatttgtatgacttactttgagaaatgtctgttcagatctcttgcccattttttaattgtattagattttttccatacagagctgtttgagctccttatatattctgatgagtagtttgcaaatattttctcccagtctgtgggttgtctcttcactttgtttcctttgctgtgcagaagctttttaacttgatgtgactccatttgtctatttttgctttggttgcctgtgcttgtggggtattacttatggttcaatcttggtaggttgtatgtgtctaggaacttatccatttcttctgggttttccaatttcttgtcatatagttgctccaatgatcctttgaatttctgtgatatcagttgtaatgtctcctttttcatctctgatttatttgggtcttctcttttccttaatctggcgaaaggattttattttttaaaaaattgttctgttgaacttttgcattgttttctttatttcaattacatttatttctgctctgctctttattatttcttctactaatcttaagtttggtttgctcttgctttgctaaatctttaagatatattgttaggttgtttatttgaagtttctctattttttcttttttttttttttttgagatggagtcttgctctgtcacccaggctagagtacagtggtgcaatactggctcgctgcatcctctgcctcctgggttcaagcaattctcctgcctcagcctcctgagtagctgggattacaggcatgtgccaccacacccagcttttttcttttgtacttttagtagagacagggtttcaccatgttggccaggctggtcttgaactcctgacctcaggtgatccacccacctcagcctcccagaatgctgggattacaggcgtgagccactgcacccagccagtttttctacttttttgatgtaggtacttatagctataaacttccctcttagcactgctttgctgtattccataggttttggtatgctgtgtttccattatcatgtgtttcaataattttttcagtttccttcttaatttcctcactgacccattggttactcagacacatactgtttaatttccatgtgtttgtatagtttccaaaattcctcattatcgatttccagttttattccattgagatcagggaggagacttgatattatttcagttttttaaaatgttttaagacttgttttgtggcctaacatatggtctatgcttgagaataatctatgtgctgaggagaagaatgtatattctgcagccattgcatgaattgttctataaatatctattaggtccatctggtctgcagtgcagattaagtccaatgttactttgttttctgtctggatgatttgtccaatgctgaaagtggggtgttgaagtctcccactattattatattggggtctatctctctctttaactctattaatgtttgctttatatatctgggtgctccagtattggatgcatatataattgttatatcctcttcctgaattgactcctctataattatataataatctggcctctttttacagtttttgtcttgaagtctattttgtctgatacaggtatagctactcctgctcttttttgatttccatttgcatggagtatctctttccatccctttcttttgtctatgagtgtctttatacgtgaagtgtgtttcttgtaggcaacagatcattgggtctttttttttctttatccattcaaccactctatgctttttgattggagcatttagtccatttacattcaatgttattattgataagtaatgacttgttttctggttgttttgtggtcttctcttccttctttccttctgtcctgtcttcctttctagccgaggtgattttctctagtggtatgttttaatttcttcctttttattgtttgtgttatcaatcatatgttttttgatttgaggttaccatgaagcttgcaaataatatcttataacccatttctttaaactgatgacaacttaacacttgtataaacaagcaaagagaaaactaattaaaatgctacactttttacatcagtatagtgtgagaaataaaaataaaaaatctgtacactttaacttcttccctctactttttattttgtttttgttttaatttataccttactgaactctgtcttgaacagttgttgcagttattgttttgttttgagataggctctcacttaacgcccaggctggctgtagcctcgacctccagggtggtgactcccacctcagcctcctgagtagctgaaagtgcaggaacatgccactacactcaactaattttttgtatttttttgtagtgacagggtttcactatgttgcccaggctggtcttgaactcttgagctcaagcaacctgcctaccttggcctcccaaagtgctgggattacaggcaagagccactgtgcctggccatttttgacttgtccatcatttagtctttctacttaagatatgagtttgcacaccacaattacagtgttataatattttgtgtttttctgtgtgtttactattaacagtgaattctgcagcttcagataatttcttattgctcattaaggtctttttctttcagattgaagaattccctttagcatttcttgtaggacaggtctggtgttgatgaaacccttcagcttttgtctgggaaagtatttcttcttcacagttgaaggaaatttttgctggttatattattctacagtaaaagttttttccttcagcacttgaaatgtgtcatgtcactctttttcctggcctgtaaggtttccactgcaaagtctgctgcgagacgtactgaagcgtcattgtatactgtttcttttctcttgcttgtaggctgacttccttatccttgacctttgggagtttcattattaaatgccttgaggtagccttctttaggttaaatctgcttggtgttctataaccatcttgtacttgaatattaatatctttctctaggtttgggaagctgttattatccttttgaataaactttctaccctcatctctctctctacctacctcctctttagggccaataactttttttttgagacggactcttgctctgtcacccaggttggagtgcagtggcacaatcttggctcactgcaacctccacctgccgggttcaagtgattctcctgcctcagcctcctaagtagctgggactacaggcacgtgccaccacacctggccaatttttttgtattttttgtagagatggggtttcaccgtgttagccaggatggtctcgatctcctgacctcatcatccacccacctcggcctcccaaagtgctgggatgacaggcgtgagccaccatgcccggccttaaggccaataactcttagatttgcccttttgatgctactttctagatcttgtaggcatgcttcattcttttctttctttcttttttttttttttttgtctgtgaccatgtattttcaagtagcttgtcttcaagctcactgattctttcttctgcttcatcaattctgctgttaagagactgaaacatccttcggcatgtcaactgcatttttcaaatccagaatttctgcttgattctacttaatcgtttcaatctctttgttaaatttatctgaaaagattctgaattccttctgtgttattttgaatttctttgactttcctcaaaaccgagttccttttgaattcggtctgaaagttcacatatttctgtctctttgggattggtccctagtgctttagttagtttggtgaggtcatgttttcctggatggtcttgatgcttgcagatgttcatcagtgcatgcacattgaagagttaggtattgatatggtttggctgtgtccccacccaaatctcaacttgaattgtatctcccagaattcccacgtgttgtgggagggacccagggggaggtaattgaatcatgggggctggtctttcccatgctattctcgtgatagtaagtctcacgagatctgatgggtttatcaggggtttccgcttttgctttttcctcattttctcctgttgccaccatgtaagaagtgctttttaacctcccaccatgattctgagcctccccagccatatggaactgtaagtccaattaaacctctttttcttcccagactcgggtatgtctttacaagcagcatgaaaatgaactaatacagtaacttggtaccagtagagtggggcattgctgaaaagatacctgaatatgtgaaagcaactttggaactggctaacaggcagagattggaatagtttgaagggctcagaagaaaacaggaaaatgtgggaaagtttggaacttcctagagacttgtcgaatagctttatccaaaatgctgatggtgatatggacaatacaatttaggctgaggtggtctcagatggagatgaggaactttttgggaactggagcaaagatgactcttgttatgttttagcaaagagagtggcaacattttgcccctgccctagagatttgtggaactttgaatttgagagagatgatttagggtatctggcagaagaaatttctaagcagcaaagcattcaagaggttacttgggtgctgttaaagccattcacttttataagggaagaagagcataaaagtttggacagtgtgcagcctggctgtgcgatagaaaagaaaaacccattttctggggagaaattcaagtcagctacagaaatctgcataagtagcaaggagactaatgttaatccccaaaaccatggggaaaatgtctccaggcaatgtcagagaactctgcagcagcccctcccatcacatgcctgaagggccaaggaggaaaaagtagtttcatggaccgggtccagggtccccgtgctgcgtgcagcctatggacttggtgtcctgtgtcccagcggctccagccatggctgaaaggggccaacatacagctcgggctgtggcttcagagggtggaagcctcaagccttggcagcttccacatggtgttcagcctgtgggtacacagaagtcacaagaactgaggtttgggaacctctgcctagatttcagaatattcatggaaacacctggatgcctgggcaaaagtttgctgcaggggcagggccctcatggagaacctctgctagggcagtgcagaagggaaatgtggggtcagagcccccacacagagtccgtactggggcaccacctggtggagctgtgagaagtgggccactgtcttccagaccccagaacagcagatccactgacagcttgcaccatgtacctggaaaagctgcagacactcaatgccagcccacgaaaacagcgaggagggaggctgtaccctgcaaagccacaggggcagagctgcccaagaccatgggaacccaactctcgcatcagcgtgacctgggtgtgaaacctggagtcaaaggagatcattttggaactttaaaatttgatggccccctggatttaggacttgcataggccctgtagcccctttgttttggccaatttctcccatttggaatggctgtatttacccaatgcctctacccccagtgtatctaggaagtaactagcttgcttttgataggcagaagggacttacttgacttgtctcagataagactttggactgtggacttttgggttaatgctgaaatgagttaagattttgggggactcttggaaggcatgattggttttgaaatgtgaggacattgagatttggaggggccagggacagaatgatatggtttggctgtgtcccccaacaaatctcaacttgaattgtatctcctagaatccccatgtgttttggaagggaccccaaggggagataatttaatcatgggggctggtctttcctgtgctattctcatgatagtaagtctcaggagatctgatggctttatcaggggtttctgcttttgcttcttcctcgttttctcttgccaccaccatttaagaagagccttttgcctcccaccatgattttgaggcctccctggccatgtggaactgtaagtccaattaaacctctttttcttcccagtctccggtatgtctttactagcagcatgaaaatggactaatacaggtatctattgtagtcttcacagcctgagacagtttgtacctatacttcttgggaaggctttccaggcatttgaaggaacttgtgtgttgtgatccaagtttttggctgctgcagccaaacctgcattagggggcaccccaggcccagtaatgctgtgtaataccccaagaccttggcggtcttggataagatccagaagaattctctgaattgccaggcctagactcttgttctcttaccttactttctcccaaacaaatgtaatctttctgtgctgttccttctggagctgggggagggatgacacaagcacccctatgtccaccaccactgggactgcactgggtcagacctgaagccagcacagcactgggtcttgctcaaggcccacggtaaccactacctggctactgtgtatattcactcaaggctctagggctctacaatcagctggacaaagccagccaggcttgtgtccctccctttagggcagtgaggtcccctctgccttgactgggtccagagatgccatccgggaacaggatctggagtcagaaaacttcggaatttacctggttcactattttactgaggctgagctggcacccaagtcacaagacaaagtccttcccacacttccctcccatttccacaagaagagtctgtttgtggtcaccaccaccccaggcacacagcaactactgcctggccactgccaatgttcacccaaggttgaagtcctcttcagtcagcttgtgatgaatactgctaggcctgggactctccctccaggtcactgggctcccctctggcccagggcaggactaggaatgccatccaagagccaaggcctcatactggggactccaagagcctgcttggtgctctattcactgtggctgaattggtacctaagctccaagacaaagacacctttactcttccctctccttttctcaagcagaaggagtctcccccagtagccatcacagctgggaatgtgctggatcatacctgaagccagcacatctgagtctcacccaaggcccatgatgagtaccacctggctactactgctgattattcagggcccaagggctctttcatcagcaggtgatgaatcctgccaggtttggatcctttccttcaaggcagtggtaggggtctagcccaggtaggtctagaaatgtcatcaaggacctagggcctggaatgggggcctcaggactgcctggtgccctaccctactgtggctgaactcgaagacaaagtcctctttactcttccctctccttaggcagaaggaacgagtctctcctagagctgcgagctgcactgcctggggcaagggaaggggtggtataaacactcccttggccaccccggctggtatctcactggactgtgtgcccctgaagtctactggctccaagcccagcacagcatcaagacttgcccaggaattgaagtccttgtggcttagactgtctttcaagtttatttaggactccagagtactttagcccttctggctaggagtggtctaaatgctccctccatggacaccagctgagttctgcctcatgatgctttctgctgtgacacagcagcactaagttccaatgcaaagtcccacagttacggcactctccctcccctaaatgcacagattctctccatgccacacaaccactgctggggcatgggggaggggtggcatcagcaattcaagactgtctttcctaccctcttcagtgcctctttcagtgataggaagttaaaaacaggtactgtgatttctcaccttatttttgcttcttatgaaggtgctttattgtgtggatagttaatttggtgtttctgcaaggatgatgattggtggaggctcctattcagccatcttgcgccacctcctccctcttttctggtctgagattttgaaggtgaagactacagaggagcagctttctcaatatgtttgcctttgtcattggtctcagtgctatgaaggaaggtggtttaggcaacaagtaattgactagcatttcaactagccctgactgggggttaattgccaataagtcacttgttattgcaggtgaccacaagccccaacttggaaatggtagtaggtattcttttttgatcttgtcatgtatttcaaccctgcagcctcagtaactcctaatagggaggttttcttgtcatcttttactccctcctgaaggaggaaagtagataaatgacgtgctgattctaaaacacctagaaggaaaatggtgcgtgcccaccaatgccatttagccttgttttggaagtacttgccaatgccactaaatagcaacaaaacagattaatatctagaaacaaatttaacaaaaattgtgtaagatcaatataatgaaaactttaaaattccactgacaactaggcctcaatgaccctgaaagaactgcccagcacagggttagacaattcccagtgatagcaaatgattcacctgcttgagccttactgaccttggagaggtcaaacaactcgcctttcatacacaagccaaccaatccagagctcataaccccaacttccctcttcatggccctctttatggtgctctcacattctgggagattatctccctacccaatcaccccaggcccgcattcagacagctagggacagcctctacaccattcctgagcatatcgacattgttcaaataaacaaatcctaaacttgtttaccctgcctcacttctttcttcctgcagtaatcacaatagggttttagcccactagttctcattctctttctacctgagacctcttcttgggaactctgagtaataactattttttcaataccaacagtctcctgatatgttggccttaccgaatattttctgttaacacactatattttaaaatacactgtaattaaaatatcagatttttttgctactaaggttaatatggaaaaatcatcaagtgaaaataactgctgggcctggtggctcatgcctgtaatcccagcactttgggaggccaaggcgggtggatcaccgaggtcaggagttcgagactggcctgaccaacatggtgaaacctcgtctgtactaaaaatacaaaaattagctgggtgtggttgcaggcacctgtaatctcagctactagggaggctgaggcaggagaatcacttgaacccaggaggaggaggttgcagtgagccgagattgcgccattgtactccagcctgggcaacagagggaaactctgtctcaaaataaacaaataaaataaccataaaaattctgaaacgcaagagtaatgtagggtggtgtggagaggggatggatggagtggctgatggagggtagggagccagggatggcactacgaaccattaaatggtttgatgaatgtagtggatataaatctcagtccacaacagtgtgaaagaaatatttattttcagtaattctatctaattttaattttgaccttcattttgccagggtggaaataaaacttcagtcattttagggcctcacgatcaccagccccccatccccagcattgctctaagaaccgctgggcttacttaatacccaggcatcagggtggacctctgatccttggtagttcatccattcaccctgcatccttgtttaaaattgtctgctatagcttttgtgatataaacccttcctggattacttccttcccaaaacaagatggtgagggagatgggaatttagctcaccgtgaacactgagtttgtgacaggggtgcaccccaggtgcggcaggaacattcagagaaaggaaggcttcatggaagagtggactgttgagctgggccttgaagcatatagccaactccacacggcaaaaatgggtgggtgtgtacagagcatcacagcagaaacagcacaagcaaagctggggctgaggtgaaaccaggtctgacttcttgagtctaacttgactgtgcaatggggaggcaattcctgcaaatatggagggacgagggaagtgagccttgggagtgaactacatggctgtagattagccactccacagagcaggctccagcaaccactgcatagaaggaaaatcatggatcttgccatctctgcaggtatttctaggccctgaatcaaaatttaaagtggttccttcaaactttgaaacaggagatccaggagtttctatgtgttcctttcatagctccctaaatggaagagtgaccatacaacctggatgtgccatgggttcactggccagctagcgcctcttctaaaagagagggccctggaagggagggaagattcaagataatctagcaaaagccagaggcaatcctgccagtcagatcagaatccaaggcatacacttttatctccatctcttcccagagtaaagtttataggattgtcaatttcttctttccacattattccatttattcagattagcagcagcaaatgcaaccagaaaacaccagataatttacacttcatctgtattttactctctgtaatagtcagtagtcagttttcttggggtttctcagtcataattcccatctggaatgtaactggtttcctactttctttcttcttttttttttttttttttttttttgaggcagagtctcactctgtcacccaggctggagtgcaatggcttggctcactgcaagctccgcctcctgggttcacgccattctcctgcctcagcctcccaagtagctgggactacaggcgcccgccactacgcccggctaattttttgtatttttagtagagacggggttccaccgtgttagtcaggatggtctcgatctcctgaccttgtgatccgcccgcctcggcctcccaaagtgttgggattacaggcgtgagccaccgcgcccagcctggtttcctactttcttaaaacagtcatatgatgttctactgtaatcactttacatttgcattatttcagagtcatgggctgcttcttcattggcatgcactgcttccccactgcctaactgtcttgaaaataaaggaacaaaaacaatttgggattaaatataattttccatttcattttctttttccttcagtgtccaaaagtcctaccattttcttgcaatggatttgagactttttttccctatggcacatacactcacttcacaaaataagctgagctacttcaaagtagcatgtatgaaataactgtagaacatctccactgagctattgttaaccatcatgagttcccatttaacacgtagttagtgaactcttaaagagtactatggctatatagagaagtgaaaatacacaacccctgatctccaggaaatgtctaatttacttgaagtaagacccagtcacttgagaaaagggaaaccactatgtctactttcacattcaccgctaagcagggattccaagtggtgttctcttctctaaattctcaccttcctaaaatgcagtggcacttattgagtgccttttatatgccaggcattgggctaggagcttctgggtggctttctgaatccccaaataaccccatgaaatatgaaagatttctggaaagactattagtagagaaagtaacctaagaaaccatttcactttgggaggttgaagtgggaggacagcttgagcccaggagtttgagaccagcctcggcaacagtgtgagacccatctctacaaaaaactttaaaaattagccagttgtggtggcatgtacctgtagtcctagctacttgggagggtgaggtgggagaagtatttgagcccgggagttcgaggctgcagtaagctatgactgtgccactgtactccagcctgggcaacataagaatacgctgtctcaaaataatgataataataataaaactcatttcccattcatctcctcaaccctggattctgggtttttctaaattaagaaaactgccataatctttcgaagctcagtttttatgaggcaattggatattattaacacatataataggatcacataagaaattcattattaaactaggggctacaaaatattctatcaaatatctatcaaccaatagattcattttagaggggtattttcaatattttatccttctaaggaaaatcttctatgaggagattaatttcaagatcatttttactaaataagcagtcaatggactctgtcaattagtgcccctggactaatgtggtctttatacacttagactgacctctgctggacagtctaataacctgtcagcattttttttttctctgagagtatgattaggaaaggggcattttccccaaattttatctagtatttagtaacaaatttacacagttcaacttacaaatattaatcaagccctctacaccacctaatggcaaaatcttatattgcattcggctgccagaggtgtgtccggaggcagagtgggaggagactgatgaggttacatgaactatccagtctgaatgctccttttcatagtctcttcctcctgtgcaggacataagaatacctgagaaatgaggctgcttccacgagcctgtcaggggccaagtcacagtatcttctgggttcacccctaaaactgaagtctaccacttcatggtggtcacttgtgcctaaactagccagtgtagacaagtctgatatgggtggtgcaaacaagctgaattttgatataaagtcctatgcttcaatttatgtaaaactgcagataaaaaacacgaatgaccctgaaaataagtgatgcttttccatttcaaatattcttttaaaatagtgcctgcttctgataataaaaattacataattatttttaaaattctataaaggaaaaaattaaataaaaattgcctacaattccatctaccaagttgtattacaattttagtttattttgtgcccatctctgttctgtaagcaagcaggtatgcatgattatggttatttccttacttcactccatttcattttgtagcttgcccttttcacacgttgtattgtgattatttttcaattaataaataatacaatttttattttatgatgatagaccatcacttatgtaaccaatgtcctactattaaacattggaattgttcctaaataaaactacgctacatggccttttatataaatatttgaccaaatattttattatttcttcaggatatattcccaaataagctcaatggggcctggcacagtggctcatgcctatattcccagcactctgggaggcagaggcaagaggatagcgtgagcccacgagtttgggaccaacctaggcaacatagtgagaccctgtctctacaaaaataaaataaaagagtagccaggcatggtggtatgcgcttgtagtcctagcaactcgggagactgagatggagagatcacttgagtccaaggacgtcaaagatgcagtgagccgtgatcatgtcattgcactctagcctgagcaacagagcaagaccctgtcttgaaaaaaaaaaaaaaaaagctcacggggtcaaaacttacgcggtatgaacatttttaagactccaaatacctgcaatgctagaattactctacagaaatgtaccaacttcaacttccatcagcagcataggagtctccattttcacttccacttcaccaaaattcagattaatttagaaagttctttgccaagtggataggccaggaaaaaaaaagggattttcagtataacttacatattcatattcatgcttttactgagcatttatattttttctgtgaattgtacattcacgccctttgcccatttttctactggcaccttaatatttttcttatatataagagttctttatatttttatttttttatttttgaaagggagtcacactaagtctgttgcccaggctcaagaacagtggcgggatctcggctcattgcaacctctgcctcccaggttcaagcgattctcgagcctcagcttcctgagtaactgggattacaggagtgtgccaccatgcccagctaacttttttatttttagtagagacagggtttcaccatgttggccaggctagtcttgaactcctgatctcaagtgatccacccgcctcagcctcccaaagtgctgggattacaggtgtgagccactgtccctagtctgagttctttatagattaaggttaactctgttggtctaaatgtggtatgcttgaacttaggtcgctagtccaaatatatcctgaaattattagtttgggtgtgatgtgactttgcctttggctcagtaaattccttccaggaaaaaaaaaaaacaacctcataaaatataggaccagccccattaaatactggtgacacttaggtactgagtggtcaaaaaataaaataggaagcagaaagagcctatgtatctcaactaactgaacatgtctctacattagacaattcttacagcttttttcttcaatttttaaaagacaggtaactgccttagtctgtttagtgttgctataaaggaatatttactaaagctaagtaacttgttttaaaaagaggtttatttagctcacagttctgatagctggaaggttcaagactgggcatctgatgagggctcaggctgcctccactcatggggggagccagtgtgtgcagagtccacacagggagagagaaagcaggagagaggcagggaaggtgctaggttccctgcggggtgctagattccctttttgtttttgttttttttttgagacggagttttgctcttgttgcccaggctggagtgcagtggtgcaatctcggctcaccacaacctccacctcttgggttcaagcgattctcctgccccagcctcctgagtagctgggactacaggcatgtatcaccatgcccagctaattctgtattttcagtagagatggggtttctccatgttggtcaggctggtctcgaactcccgacttcaggtgatctgcccacctcaacctcccaaaattctggtattacaggcatgagtcactgtgcctggccactaggttccttttaacaaccagctctagtggtaactaatagagggagagctcattaccctgagaactcatcaaacatttcatgagggatccatccccatgacgcaaacacctcccattaggccctacctccaccactggggatcaaatttctacatgaggttttggggaacaaacatccaagctatagcagtaaaataatattgatatgtaaatcaacatttaggcagttacaatgctattatgtaataaaagctctccattcatctgtaagtagttttgtggcagaataactttttctgttactttttctaactttttctgtttttaatcaattcctttactgtaaaatgtcattttaaatgtttattttattttgcacaattttaacagtagagtaattttgctgtggaaaataaaatttcatcttgcaagaaagagaaaactcaagaccaccaactggcgtctttatttacatattagagcgggtcagccaatgaaaatcctagaaaaagaagacaacaaacattcagtcaaaagaaatgattgtctcaaattatatcctcattgtttcacttgttctaaaacctaaaagtcctacacaatggtggcaaaatgaggtttgtctttgttctggtgcttttcccaaaaaggacctaaaaacctattagtgaatcttcctgctgtgtcctataaaacaacctaaaatggcattctgggtcctcttccattcacagtaatcagagcacaaaaactatagtctaaaagaaccagaagtacactcagaaggagaagggagatgaaggaggcccacagagggctgagctcccaggtctgaggacatgagtaggaagaactgtgcacggaagtcttttccagaactaacaccatcctatacatatggcctggacacaggcacagatataggcattcccatattgaggcaggaagtggccagcctacactgagaatcaatgataaatggcagacggacagaaagacaaaaatcaacagtttggaaagtataatgtatgtaaattccactggaatgaaaataaataatttcaaagtgataaatgtaagaaatataaaaataatcctcatagaattgtaaaagaggaagacgagaactcatatttctccagcaatatccagcaatatccaaacaaaattcatagagaaactgtagaacagatcattggaagcaaatcaatagcatgaactcactagcagagatgacagaatttgttagggcttttctgtgattaacataggtctcaagatgatgatgatgattattattattttgagagacagtctcactgtcacccagattggagtgcagtggcacaatcttagctcactgcaacctccacctcctgggttcaagtgattctcgtgcctccacctcctgagtagcagggattactgacatgcaccaccatgcccagttaatttttgtatttttagtagagacaggtttcaccatgttggccaggcaggtctcaaactctcagcctcaagtgatccgcccaccttggcatcccaaagggctgggattaccgtgcccagccatcaagattatatgtattcattaagcttcttacagtggctttagtttccccagggctctgatggcctgatgcccggaggagggtgtttttggttaccaaactaacatcccagtcactggaaagtataaacctagttataaatccataaagtggcatgagatgaaaaagcctgtctattgagtgtctgactagcataaatcattttaaatagaacttaaaaaaagaaaaggcaatccacaaacccacaggagtacagatagattctgaaagtggcagaccctcccttaaaacagtctgcctgcttgctccacagaaatccctgctaatgccccctgcccttcagcttactaggctagtttttctgcattcatcttcctcatcactaggtttcttgagtatctcctctctctgctaggaagtaaatgccaaagtcattgaaatctgtttttacacaaatagaatttcaatagaattctatatattttagtgtctaaattagttaatttatatttcattgattatccaggtatctgtttacccattcatccaccgctttgttcacaaaagaaagagattccatatatataagaaccaagacagaaagtacttgaaaaaaatatctgctctgataagagtggctgatacacaaactgttcgcacggaagacaggttatatgaggcggcaagtggcagaaccaggatggcagtagaaaattaagtatgaaatgcaacttactctgggataggagaggctcatgctatgaactttgtcatttactttactgctgtaatcaacactgcagtttcaccctggaggtcaaagtaactaattttgaatgtacctgcacaaatccttgtattacagttgcatctccctcttcctcagacttgccatgcttcctctttcctcttgctacagagcctgttgcacatctcttccctctcccctttgccgagttagtctctgcttatccttctgatctccgtttaagaatcacctcctctgagaagccttccctgtaaccccaacataaatctgattcctttgtggtacgtttgctcagaactggattcctttccttccaagtaattgcttcactctgtcatagtgtgttcagttgtgaggttaccagactgtccctctcccctaccagactacaaaagctccatgaagtcgtgaggaccgagcctggtttggctcaccatgctattcgtagcacctaacacatatctcaatattcactgaacaagtacatgaaactgccaaactcagaaatggtttagaaagacctctgtggatgatagagggtgttctgtttggtagatactttttggagggggataggggaagcagatgcatttcttgctttctgcttagcaactgtatttacctgggccttccgtgtggcttgtggctcaatcatgatgttgataagagaaggtttagttgtgtctgctaggctctgcctcagggatttttggagttcttctggtgtttgtacaaaataccctttgcctccaaatgcagtcatgacttgctcataatgtgaatttggcagcaaacacattggagggaccctgaaaaacaaggtcatgagtcaatgaaatttaaatcttaaaccttgtagaaaaaaagtcattctctgaaatacttcattaaaaaaatttcagctgaactcaaaggcatacttttatcttcaacacttaagctgagatgccagtacactgagtttttcctatatttataattgtctatatagcaatgtccagtagaactttctgtgatgatagaaatgttttaaacctgtgccatccaagacagtagccactatctacctgttgctgtgagcacttgaaatgtgactaaactgaggaactaaatttttaatttcatttaatttgaagtaatttaaatctaatttgcaacagttgcagcatgcctagtggctactatactagacagcacaggctacattatcaactattatgaatccagaagaaaaacatgaaaaaaaaagattactgcaaaacaacaaataataagaaaacaacaaataaagttagtgaggcataaatagacacacccataccctgttccaccccaaggctggctcacaaattcatatctgtctcacattctacggccagctacaatactgtcttaatctggctctgccatcagatgatcaagatttagctaagtggtgaaaggaaggtagacctctggaacacaaataatacgtaaacatccacatttccaaatggtgtaacaggaatcagtagtcctactattgctcccagtccagggagcattttgcaataagccttttcattaacaaggctcagacatcacactcatttatctgagtcttcagtggctccctgattatttactgaagcacctaatcatggatatttgtgcaaagaggaactaagacaggattccttctctttagaagggctgacaatcgaaacggacaatactcataccatgtaggcacattactgccaatatagaagactttttaaaaagagattaaaacgggaaagagaaagtaaacagacattggtcttggttacttacactgcagtagcatcttgaaattttaacatttctttccaagtatctgtatcaaaaccttggtaaattccattgttattcactaccaacagtatgattggcaagttgtacctaaagtgagagtaaaatatgaaggaaatcattcttcattttaaagtaatttcttttctttgggttgaaactttaacttaaaaatgaatagtttcctataagctttttgtattattagaggaagactaaaaatcaagcatttattatcctaagaaagaatatcaaataattaacagaaacatcatggaaaggcagaaagaatgcaagattaagagttgttagtcctggctgggcatgatggctcatgcctgtaatcccagcactttgggaggctgaggtgggcggatcacaaggtcaggagttcaagacaagcctggccaatatggtgaaaccccgtctctactaaaaatacaaaaattagctgtgcatggtggcatgtgcctgtagtcccagctactcgggaggctgaggcagaagaatcgcttgaacccgggaggcggaggttgcagtgagcagagatcacaccactgcactccagcctgggtaacagagcaagactccatctcagaaaaaaaaaaaaaaagttgatagtcctttagctattagctatgaacctcagacaaatcactgagcttttctgaatctgggttttcataagtctagatggtatatgaagaacaccttccctatttaatactctctaaagtaccacttctagttggttcctaggaacagtgtttgaaacgtacctttctatttactgagctccccacagacacccagctcttgctagatgctgtggaagatacacaagtaactagcacacacaatctgcactcaaactaccacacacataatcagaaacacattacatggtgtagtcagtacagaaaaggagtatttaacagtgtgctaaacagtatagcaaagacaaaaaagaaaaggttgattaaatgttattgactgaaaagaatgtaggttttattttctaacataatttccaagggcaagtggtaaaaacaaaactaaactgcatactgttaaataacaggactgtggtaattatttgctctccatgctcaaaaggagtcattatccactaaaaggctaacttccccataagtcatcttttttgtgtatatcacttggttgtcaataaagacactctaacagacacatacagtcagacctcattatctgagttctgcatccgtggatttaaccaattgcgggtcaaaaatatttgggaaaaaaaattggatctgtactcaacatgcacagactttgttcttgtcattattccctaagcaatacagcacaacaattatttatatagcattcatattgtattcagtattttaaagtaatctagacatcattaaaaatatatggggggtatgcataggttatttgcaaatactgcacaattttatatcagggacttacttgagcatccttggattttggtatttgaggaaggtcctggaaccaatcccccactgatatagagggacaactataccttcccaaatcttgaacgttttatctaccaaagctttgccaaccccaaaacatgattcacaaaagccctaataagagccctggctaagaatagaatggttttactacagtttaaatatagctggaaaaataaaacccccatccttctatagtgaggatctacaattcatgagtttctccatgaattctcataactacacacatgatccaaatgactcatgttcactgagcatcacctcagaatttagctggggccaagcatggtggctcacacctgtaattctagcacttagagaggccaaggcgggtggattgcttgagcttagaaatttgagaccagtgtggccaatatggcaaagccctgtctctacaaaaaaatacaaaaaattagctgggcatggtggtgcatgcctgtgatcccagctactcagaaggctaaggaggcaggatccgttgaacttgggtggttgacgctgcggtgagccgcagttgcgccattccactccagtctgggtgacaaagcaagaccccatcttgaaaaaaaaaaactgcttggattacctcatttgtttttcataatcatctttctaaggtaggaactattactattcctactttttttttttcaaggaatttctgcctaaaggatactattcctgctttagaagagaggagactgaggcttggttaagtgactttttttttttttttttttttgcgatggagtcttgctctgtcgcccaggctagagtgcagtggtgcgatcttggctcactgcaaactacacctcccaggttcaagcgattctcctgccttcagcctcccaaatagctgggactataggcatgcaccaccacatctggctattttttgtatttttagtagagatggggttttaccatgctggccagactggtctctaactcctgacctcaggtgatctgcccacctcagccacccaaagtgttgggattacgggcatgagctaccacgcccagccttggttaagtgacttaaagtcacatggctctgacttgatagaaccagtatttaaatccaggccatttgtcccacaagccatgctgccttttttttttttttttttttttgagatggagtctcgctctgtcacccaggctagagtgcagtggtgcgatttcagctcactgcaacctccacttcccagttcaagcaactcttctgcttcagcctcccgagtagctgggattacaggcatgcatcactgcgtctggctaatttttttttttttttgtatatttagtagagatgggatttcaccattttggccaggctggtcttgaactcctgacctaaagtgatctgcctgccttggcctcccaaagggctgggattacaggtgtgagccaccatgactggcagaagccatgctcttcaaccaccacacttgctatttcccacaggaaacaagcttctttcagtccccaacatttttttctcagtgacctcaaaaccactccccacagttttacaggtttttaccatacagtgaggaggccagaaagatacggttctggaagagaaagaccgtgggttactgccactagcatcctcaggacagaacacagtgctgtgcacagggcacctggtgaacgcttcataagtatttgtcaggtgactgggtcttgtgtgtcatttttcatattctagagaatcaaatgctctgattcaggatgatgttttacctgcagatggtttctacctccatgccagaaaacccaaatgcactgtctccttccacacagatgatccattgcccagggcttctatctttagccaccacggcagctgcaatagcaaatcccaaaccaactcccattgttccgaaagtaccagcatcaagcctgttggagaacaaagttaaaatgaaaccctctggggcatgtcatagaggatgggattggcacaaaccttctagtcatatttacatggttgatggaaaaatgaagaaccataaaaacattctctttcttcaatataaaatctttagactgctaggaactaatttgtcaaggatagaaaaaagccacccatgtttgcttggaagactataaacatattcctagaatactaagtaaacaattatcatgataccaagaacacatcaagcataaaaactctacaaaacctcacctaaggatacttttatgaaatatgtccttacatactaaacatgtattaattctcaaacgtcttcttaatctgcactattacagtttcatattaaacacattataatgaattacgacttctttcttctttagaagtcttacctgtgacgaggaaggtagttctgaagcacagtccgtccaatgtccatagtatttgctccttcacttaccacgaaacagtctctaggtagttgttcttgaacatggtagaatactgtgtaataattcataggcagggattttttagaagctagttcctgaaaagtagatgggaatataatcaaattaaattgggatacaatgaaaataaccaatgttaataagatgctatcaaacttatttggaaatacgcaacaactacaagctacaaggtttccaaatggctataaaatggccactctgagaagttggctgacctgtgaacagccctgggggacatgtgtaccacagtcccagttgggaacacaattaaataagctcgggaatatcccgcctcttggagatctgcaatgcacaggagtgtattaaagacattgagaagtcctacagtaaagacagctgagaagcactgggttacataaaactaaacgttcttatttgagcactcttaggaaaacggtgccttagaaaaagtgaaatttattccagaatattttcatctgaactatgaccctaaacttaaaatgtcacaattttagaatacaatctgaaaatctagtttttcccccaacacacttaagagttaaaggagctatcttacccccactattctaaagagtccctgaatggagagaaaaacagcaaggtaaacgcctttgtctagccacatgcctttcagggctgagaaaaagccatagagagctttagcagcaacagtcccatctggccccaggactgcctcttcacctatgctactttgttctgctggagattatacacaaggtaaagagggaccctcctatactcctgcactaaagaagagaagcaagtcccttctatcttaaaccaacatcgttcctatgcgaaagaaaagattagtcatgatatgactcaggaaataaaattgagactggtggccaggcatggtagctcacgcctgtaatcccagcactttgggaggccaaggcgggcggatcacgaggttaggagttcgagatcatcctggccaacatggtgaaatcctgtctctactaaaaaaaatacaaaaattggctgggtgcggtggctcacgcctgtaatcccagcactttgggaggccgaggtgggcaggtcacctgaggtcgggagttcgagaccagcctgaccaacatggagaagctctgtctctattaaaaatacaaaattagtcaggcatggtggcacatgcctgtaatccagctactcgggatgctgaggcaggagaattgcatgaacccaggaggcggaggttgcggtgagccaagctcgtgtcattgcactccagcctgggcaacaaaagcaagactccatctcaaaaaagaaaaaaaaaaaaagtagccaggcatggtgccagctacctgtaatcccagctactcgggaggctgaggcaggagaattgcttgaaactggaaggcagaggttgcagtgagctgagatcgcgccactgcactccagcctgggcaacaagagtgaaactccatctcaaaaaaaaaaaaaaattgagactggctccagatagaaacagtcattgattaaaattctaatgtaggccaggcacggtggctcatgcctgtaatcccagcactttgggaggccaaggcgggcggatcacgaggtcaagagatcaagaccatcctggccaacatggtgaaactccatctctaccaaaaatacaaaaattagctgggcgtggtggcacacgtctgtagtcccagctacttgggaggctgatgcaggagaattgcttaaacctgcgaggcagaggttgcagtgagccaagatcacgccattgcactccagccctctagcctggcgacagagtgagactctgtccccaaaaaaaaaaaaaattccaatgtaagacagattcatgtacaatcaattctgctataatgtttgatgcgaaaatgtgaatttattctaagacaattgatatattagggaaccaagtgagcataactcaaattttatatttgcttatgcgtgattccaccagtaagaaacactggtggaatcacgcataagacacagaaaactgcacccagctgaacaaagatacatatgaatacacaaaacaataaaaaaaaaccacctttctcacatagggaaagcacaatacacacacatgcacacacacacacacacactttactagaaatcgccaaatcctgcagcactgactcattttagtgctagtagtagacagtttgatggtttctagtatcatcactacaatttccaaaaccttagctaccaggcaaagccaagagtgcaaatgagagcgctgcaaaaaaatttccagcagtgataaaaatgttaaataaaaaagaaggctatacattggatcaaaatttcaatttttatgaaacagctattataatagcacgccctgaaggacctatatcttaaaagcagaaaaacatctcaacccaagatttaaggattcaaaaaaaaaaaaaccacttaatagttaatttgtttttcttttagagacaggttctcactctgtcacccaggcttgagtgcagtggcatgatctactactgcactgccacctcaactcctagagtcaagcaatcctccaacctcagcctcctgaggagacaagacaacaggtgtgtgccaccacatctggcttttctttttttttttgtagagacaaggtcttgctatgcccaggttggtctcaaactccaggcctcaattgatcttactgccttggcctcctaaagcactaggattacaggtgtttaattgtgatgttctatgccaccatcaaactgaaggcacacccatccacttccactattatgactttctatccaatgtccaatcaccttccttccaccagctcacagtaactcacaagctacaacctttcagaaacttcaggtctttttcaaggtaaaatgctatattcattggcatatatttcttaaccatttaacacgtttaaaacattaggttcttatcttatttttatgttacacaaagtttttgagagttgtgccactaaatccctttttccatgagacctggggttttcactgcacaattttgcacatcaaggtgatttttaggaatgcacatgtcacattacggcagaagtaactgaatcatgagcctgacctgttattgagcgtcagtaggtccgattttaccttggatgcagcttcattgctcttcattttttctctcagagttttccaccacttgctctctggaggatactgccatggtgttttatcaagttcctctaaaagcttaaaaaaaaaaaaacacacacacacaaacacataaactttttctttgccttttttttcttttttttttttttttttttttttttttgagacgaagtctcgttctgtcacccaggctggagtgcagtggcgcaatctcagctcactgcaacctctgtctcccaggttcaagcaattcttctgcctcaacctcctgagtagctgggagtacaggtgcctgccaccatgctcagctaatttttgtatttttagtagagacgaagtttcaccatgttggccaggctggtctcgaactcctgacctcaggtgatctacctgtctcggcctcccaaagtgctgggattatagggatgagccaccatgcccagtctgctttttaaaaataaatttaaatcatattaacacggaagtatcttcttaaagaagactatacggccatactacccttcacattactcagactctttttttcttccagttagtaaacacctgatagaatcaatgggaaacatggaaggcttttgtttggtcagtgtgggtgtctgccagatgctaacacctgatagaaaatcaatgggtaacatggaaggcttttgtttggtcagtgtgggtttctgccagatgctgggatgcccataggacagactggagtgctacctcctccacacctcaagcaagggctctgaaaccctcctcggtctttgacactggaaggaaaaccactccttccacagaactcttgcaggaaaaccaacaaataaccacggactcctatggtacagaccaaatgctccagagtgatttaatatgtgattcaagattatatcctatattgtgtaatcatgacaacaataccaaattgtatcatccaaaatcaagtgataaatgtgactatattttatctcctgtcacagtgaaatgtacaaactatgtacaaataataacaacctgtggaaaagtcactgattagtttgaagagtaaaaagctcttttttacctaaagaaatacttttagatttttccagtgctaagccattcttgccacttcttggcagtaagttcagttcctttggaaggtatactttttcagatagctggatgctatttaataaattagtaaatttagtatattactgtttgcctactgaaagatgttacattttcaatcatcttccaaaaatgcttaacttacataaaaatgagctatgtaccagaagttggacttaacaagttccaaagttgtatttaagaatagttttcaatcatacattttgtttaaaacagatatgaatagtagacccgttaccaagtgaatcaagattaaaacattttcaagaattgactattccctaataagcactccacataaactaaaacaaaagttctcacctgcttagtgacagcatgtatgtttcctagcaaagtaacagcgggctttacattattccccaattcttctgcacagatatcaacctaaaaaagagacaaggctaaagaacaacccatgtttattctgaaaaatatgtaagaaggcaattacgattgaataaatgaactgtgtatatagaacacatgataaagaagatttgatattcagaagttccttaataaaaaaagtaaaagtccatagaactatattagtatcatagctagtatagagagcctcattatcttccctcatttaaaaatctactctatggaattttggtattgcttcattatacccatagggaatgcatttgacctgatcaattatagttttgcatctaatcagtaagttctattgaattacatttggaattcctatctagagtgtgggttctcaaatataagcatatatcagagtcacctggtatattctgggcttgataaaccataaactgtaggagtctacctcagagttttttattttaataggtctggcgtagggtccagaaatgtgcatttctaacaggtttcgcaggtggtgctgatgcgcctggcccagggaaccacatttagagaacaattccaagaacatggcacgattacttctccatttactcagaagttccatgtctggatggccatggacaaatgatggcttctgcaaggaggaatactttagccaccccaaaggggatgtatctcattctataatcaagagggcaatcaagaggtattggcatcttccaggtaactctgtcttgtttgtctgcagttttagttctcaactggctcagctgggaaaggagcaattagaagttgactccttaagaagtaaaaggtagactgggaaaagggcaactgtagctggctcatcaaacatcaagcaacccaagcacagtggctcaagtctgtaatctggcattttgggaggctgaggtaggagaattgcttgaggccaggagaattgctgagaccagcctgggcaacatggcgagactttgtctttacaaaaaaattaaaattagccaggcattgttgtacgcgtctatagtcccagcatgtcaggaagctgaggcaggaggatcacttaagctcgagaggttgagactgaagtgagccattatcgtgccactgcactcctgcctgggtgacagagccaagatgctgtctcaaaaacaaccaagcaaaaacatcaagtaaaatggggcgaatccgtgtagggcaaaaaggtttgcacaccactatgcaggtagtactttccacaccagtaaagaaaatggcttataaggtgggtcataatgatacaagaatcatcaaagacaggtcagaatacattccggatgctgtttaatgacttgtaaaacagtgtcatttagaaattcccattggaagggtgaaagttttggcatctgaaagaaaacctcactccctaacaaggccaaatgttttgttctagtctaccatcctacttaagtctcttttctctacctttaaatatacttgaattgtgaataaaagacaaattatgctttctaaactatttgaaacttgattttgaaaggttttctggctagaagtggcacactatatttcataggctagaaaaggaagcttattttggtacctataattatgttagacaatttgtaaaattctacttgtgtaaaaagagaacagtttttttaatagtaatcaagaagataacagagctgattacggctgatagggagaataatgaacatagacatttctgattttaagttcctcctctctaagtacctggataaacttcacatctggctgatatcttggaggcagtccaaaatgtaaaatccaatttagtctggcaccaaataacacaattacatcagcaaattgcaaagccctattaaaaaaattgatatgaaagtataactacatttcttatttgaattattcgaaaattcatctctgaagtatttgaaaagtctaaatcatttggagcttacatcagacttcagaatcagcttctagggtatatttgatctttcaagctaaaataatttataaaaccattctatataaatagttatctaaaatataaattaagttaaaaaacattaccataagctgtatctacactcttttattacttttttataattagaaaaattagtacaagtacactgtaggcaatccagaaaaaaaacagaaaaagtataaggcaaaaaacaaaatcaccccataatactttcaacttataaactattatgaatatactggcaaattttcatctacttttgttttctacgcaaatacatttttacatagttgagcttatatactataatactgtctcatacactttttttattttgttttgagacagggtctctctctcttttgcccgggctggaatgcagtggtgcagtcatggctcactgcatcctctcctctcaggcttaagcaaccctcctacctcagcctcctgagcagttgggactacaggcacgtgccactgcacctgactaatttttaattttttgtagagatggggttttgccatcttgcccaggctagtctcgaactcctggtttcaagtgattcgcccaccttggcctcccaaattgtttggattacaggcatgaaccactgcacctggctgtctcatatacttttgcttacataaatgttttcctggcctggtgcggtggctcatgcctgtaatcccaacactttgggaggcagagataggtggatcatgaggtcaacagatggagaccaccctggccaacatagtgaaaccccatctctactaaaaatacaaaaattagctggttgtggtggtgcgtgcctgtagtcccagctactcaggaggctgaggcagaagaattgcttgagctcgggaggtcgaggctgcactgagccgagatcacaccactgcactccagcctagtaacaaagcgagactctgtctcaaaaaaaaaaaaaaaaaaaaaaaggtttcctttctcattaagttcttaaatacaacttttaaaggctacatattttgctgaacacaatataccaaaatttatttaatgttttctcaattgctagatattttgttattaatagtgctggcttgcacatcttcacacttaagtcttaatgcactcttcacattggtccctagaagcaggttatttttaagactattgattcatattccagaattgctttctaaaatattacaccaattagatttctaagttttattttatatattttaatacttttgtcaatataacttctaatcttttaatgatttctactttcgtaaacaaccacccttgctttctttttctttacttcacatatctttgcccagtcttgttttaaagctgtatcattacgtttccgatgtggctcttataacacatacagttgctgttattactaatctaatctaatctgaatgtctgcctttttccaggagagtttattatcataattgtcataattgctgtgggttttgttttgtttttcacttctcatttttctgctttttatctgtttcccctttttcctgtcttttgccatacaggatctgtatctactgcttttgtcttcttcagtgataaatgcaatttttcacagaaattatatactcataaattgagtacatactcaaaaatcatctttaatattgtattagtcctatgagacccaatttaacaaacagataactgcaatcagcaggacggacttgcttactgatactctaaaactcttgaaatcattgattcaattatttatagtcccttgtaaccttttttacactggtaatgtcattaatattatcctcttaaaatctggctagactgaagataaacttcatttcaacctaagtataaaaaaattaagtgtaagaattaacttggttactgtatatagtaatataaataaaaatacaacatattaagatagcattaagtgaggaacaattaaagatctagcagcaaacattacatttaaaaagccctcagaagccaggtgctcacacctgtaatcccagcactttgggaggccaaggtggaaggatcacttgagcctaggggtctgagtccagcctgggcaacacagtgaggccctgtctctacaaaataaaaatcaaaaaccctcagaattaattttaacccatgaatgaaaatatgaagaacaccaaacacatgacagtaataaactacagaaagggaagcaagaaatggcatcaaaaaagatatttaggggactgcaaatgaatccataattttttgcttcctaaaaagaaaaaaaaaaaacaccttaggccaggcatggtggctcatgcctgtaatcctagcactttgcgaggcctagaagggtggattccttgagcccaggagatcaagaccagcatgggcaacacggtgaaacctcgtttctacaaaaaatacaaaaattagctgggttgtagtggcacacacctgtagttccagctattaatacttgggaggctgaggtgggaggattgctttagcccagcaggcagaggttgcaatcaggtgtgattgcaccactgcactccagtccaggcaacagagcaagaccctgtctccaaaaaaaacccaaaaaccggctgggcgcagtggctcacacctgtaatcccagcactttgggaggctgaggcgggcggatcacaaaatcaggagatggagaccatcctggctaacacagtgaaaccccatctctactaaaaatacaaaaaattagccgggtgtggtggcaggcgcctgtagtcccagctactagggagggtgaggcaggagaatggtgtgaacccaggagacagagcttgcagtgaaccaagatcgcgccactgcactccagcctgggtgacagagcaagactccgtctcaaaaaaaaaaaaaaaaaaaaaccaaaaaccctaaagcaatataaaacaatgttaataactgatgcaatcctacttcttatacattactgccaaatgaaacctttttttacttagagattcatctgtctatattttttatgttgatgctgataaagttgagtggtggttatgtaagtgttcattacattattctctcttcctgtgtgtatagttagaatatttcataataaagacatttcaagaaattaaaaagaaaaaagttatagtatattaaaaagcatgccttaaaaatctaaaaagaggaaacttccaatgccagccaagattggctaagtttgaagaagcaacccacacagagggtaagtttccaaggtatttctcccccgtgttttgtctcctggctttgactcaaaggcagccctagttgcagaactgcaagcagcgaaaacttgcagagaaactgtttttttggccaaaggatcaggaaaagggccactgcaagctggagagtatggggggaaatgtcagattttttttctttttttctttatctccaagctctgctctgagggcagccttactgcagagctgcatggtggtggctcccaagcagctgaaattccaagagaaacgtcatctttgaggcaagagggattgggaaaaagggtccctgtggtctgaagagtatggggacaatccccattatttttttcttctgcagcttgttcagagggcagctttagttatgtgatactataagggagcagcaagagccaggaaaaggggcaactgagaatgggagagtgggggtgtggagcctacagaggagagaaaataaatccctaattctgggtatgaaccagtacatgtctggggctcacccctgagctggacatgtgcagacagactcaaaacagcacagcaaaggctctgaaactgaagtgaccctggaactacttatatatggttaagttcacacttcgatttgtagtcaagctaatctaatcacgttgactgattgctaagagaaaccaacaaaaatcaacattctacagaggattttaatatgacccagaatctccaaatacaatatccaaaaatccaggatacaatccaaaattactcagtacaaaaagagccagaaaaatgtgatcaactctcaaaagaaaagataatgaatagatgccaatctgagatgactcagatgttggaattaataaacaaagactgcagaaactattataatttaccccatcatgaagtatagaaaaatattcttaaaagaaatgtaaaaatagaagatctcagcagagaagcaaaatataaaataaaaggattaaaaagaaatgaacagatagatactcggggacatgtcagacagtatcaaaatggatgaaggttgacatagaaaaaatatttgaagaaagaatgatgaaaactttccaaatttagagaaagacaatttagagaaagacataaatttaaatattcaagatttgagaatcccaaaaggctaaattaaaataaaccatttccaggcacatcatacttaaactgctgaaaacaaaagacaaaggaaaatcttgggaacagccatggaaaaacaacatattacatacagagcaacaataatttgaatgactgcagatttctcatatgaaatgaaagccagaagatagtccaaaaataaacaggtatgcttaaaattccatgattctttcagaactccatcctagatgaagatcacaaaataatttaaattagcctaaaatctaccaagccattgtatttaaaatctggaatgccacacacctggatctggctgcacctacacagtatggatggttgtcagggacaacacccttccccataggggtgggcaaaaatggcagtttatattgctccaccaatttcttgatactctcttctgcatgagcgtaagcagcacctataagaaatgcaaatgtattggacaattcagttaagctataggcactgtgacccttaaaaaagttcatgtgaaattgctttttacttatttatattttgagacagggactcactctatcacccaggctggagtgcagtggcatgattttggctcactgtaacctctgcctccctggctcaagcaatctttcctcctcagcttcccgagttgctgggactacagacacacatcaccaccgcactcagctacttttaaaattttctgtatagacgaggtctccctatattgcccagctggtatgctggtcttgaactcatgggctcaagcaatcctccttccttgacctcctaagaaattacttgtagatcttctcaaatactctccttctgcctatacctgggcttaaactcaaaacaaattgtgattacagtttttatcgctggtattttaaaatgcttaacaaagtaagagttctaattttccaccaataacactctcaattatcctgaaggatgtctatcccaaaacaaaagtcacatctcacagctcttgctactgtcacttacccattctatgctatggtcctactaaactacactctacaagtccctgaacacactatcttcattgagaggcccaggtggccagggaaaaatgttgccctgaaagagaaaggctctctctaccctcatatgttggtcctcatctccagtaaacctcctctacacaaggcctcctagtccaggcatggaaattctaaggtgcattaagtttctaaagatctgcagatctttctacaggctctgtaattctgtgattgtaacagagctaaccccagtgggacacattatcttttttgttgttgttgttgaggcaaagtctcactcttgtcacccaggctggagcgcaatggcgcgatctcggttcactgcaacctccacctcccgggttcaagcgattctcctgcctcagcctcccaagtagctgggattacaggcgcctgccaccacgcccagctaatttttgtattttcagtagagacagggtttcaccatgttggccaggatggtctcgaactcctgaccttaggtgatccgcccacctcggcctcccaaagtgttgggattacaggcgtgagccaccacactcggcccacgttatcatttgttttcacagttatgtgcctgggaataaccctctgccctattcccttgatgacattaaaaataccttattgttcaaatgttccatttctaatgtcatcaagaccactatttttttttgctattttataatttttcaaggctagtatattattccatattctgtatatataattctctactgaatcctagtaaacagtatcatgcacttgcagattcaatataatgctccactctacaaaactaccttaaaatcccttctcatacatgtatgatgaaaaatagttccttttctttaatccagaaagttttcttgtattctccttcctgtctcaatgtctttgtacactcagttctctcttcctgctttgcctttggtctctgtccacttggtgaactattgtctgctttttcaagatgcagctgttgtgtcatctcttctggatagtccttccatactatctacacaagcaaattgttgctgctttccttgaaaacccacctcaacctctctgtacacaccacgcaagaacataccgcacttacttgttaccaggtctatctcccctccccaataggtaggaaccactatttctctgtatccctcatgaatgttttgtgtaatccctgccttatcataagcattcatcaaatgtttgttaaaagaagaatgaaaactagcatccactgagtgctttccacatattttgctatttaattatatcctattgaggtagttaatatccctattttacaagtgaagcaatctgagactcaaagcagttgtttcccaaagtcacagagctaatacatcatacaacacattccactcagttctgacctcaatttttttgtcatacactatcaaactatttttagtttctacagatttagttcctaagcagttgataattgattagcatggtcataggtgatcccagcagcctcagttccagaacacgaaatggatactataataaattgctgacaggagtataaattggttggtacaacacctccagagaaagcaatatgacaatatacactaaaagtcttaaaaatactcataccctctaacttttctttctaggaaacttaaatcctaaatatagaaaaagctttaggcacaaacatgtctgccacagctactctaaacagttactggcaaagatttaaatatttgccaggaaagtaagtgttaacgtacacatgaagagacattaaaaattatatttaggaaatacttttaagatgaaaaatattataatcttaaatgaataaggtagaatataaaacggtctataatatgagcacagtacataatctatgtgtaaaaaggaatagaaatgtactaaatattaaaaagttaccttagatgaaggaacttctacttttcttgatttttccaaaatgttttataatagaataagcacatttcactaataagaccaaagaaattaaataggtagtatttccttaaaagggtgaaatctctgggcattaaagaataagtctgtaatttcaaaacaaataatgctaaatggatgaagagaattcttattccaatctcaaacattagaatagacattaataaacaatgaaagtttgtaaaaagaattggcactttcaaaagcctagcaagatttagagttctattcatgctacctttcccgatgataagaaggggttgtttggcattcctaataacagaagccgccgtgcacacagcagaggtttctgccatgctaataggaggtgacatgcagcgttccatgtacctggaaaaaaagagccctattaattaaaagaggccaactatgatctttttattgtgaaaatttcaaatatatagaaaggtagaaaaaatagtacaataaatctccatacacccccatgtagatctaacaacttaatatcattttaccacatttgtttcatatatacacacataaacatgcatttatttttcatgaactattttaaagtaaataggcatcaagacacttcacccttaaaaatttctccatgcagctgtgaataaggaccttctcctatattcaactatcacatcattatcacatctagtaaattaacagttattccctgatatcatctaataaccagtgaaatggccaattcattaacagaaaatctgagttaatggctttgtactgtagtagcagcagtagctgtcctaacagtaaaaacataataaaatctaatatttgctatgtgccatttattctcatttaactgtcaaaacaatgaggttaggtattaacatcatctccatttcaccactgaggaaaaaaagactcagagaaagtaacttgtccaagatctccagatggcacgtggcagagacaggactgaactagtcattctgtctccaaagtccatgcttttaaacaccttaccacatttctcttttttttttttcttttctttttttttttcttttgtggagacagagtcttactctgtcacccaggcttaagtgcagcggtgcgaacttggctcactgcaacctccatctcccaagttcaagcgattctcctgcctcagcctcctgagtagctgggactacaggcacatgccaccaagcctggctaatttttgtatttttcgtagagatggggtttcactatgttggccaggttggtctcaaactcctacctcaggtgatccacccacctcggcctcccaaagtgctgagattacaggtgtaagccaccgcacccagccccactacagttccactcactgggtgttaatattttagtatcataatatgcattagtaaaagaaatattcaaactgtcacagttaagtatttctggacaccaagtcctgtgctatttcatttattctaattaatataaattatactgtataaaatttagacatattgtcaaaatatttagacatataataaaaaaggacaatctgtataaaatttagaagaaggcttacagagttaacttacctgagcttaccctcctccccttagtagtattttgattatcatgttcaggtattaggcagaataaacaagtgtcttttttatctgactctccgaaataaaaaatcactcctggctgggcacggtggctcatgcctgtaatcccagcactttgtgaggccgaggttggtggatcacaaggtcaggagttcgagaccagcctggccaacatgatggaaccctgtctctactaaaaatacaaaaattagccaagcatggtggcgggcgcctgtaatcccagctacttgggaggctgaggcaggagaatcgcttgaacccaggaggcagaggttgcagtgagctgagatagtgccactgcactccagcccgggcaacagggagagactcagtctcaaattgaaaaaaaaatcactctttggtacacagagtatacagtaagacccactgactctctgtagtcactagagaaccatttggtccacaacagcagaaacgcactaaacagtacccatgatgctttaaccctaagtacctatctctatcaggggatgatttagataccagtgaaaaatgctttttgtacttcttttcacttagtgtttatttaagaaatatgagaatatgagaaatcatagaaacctctatactggaatatttgttaaccacagagagagacagctagatgttttttatcctgagtcctaatactttttaataatcacccaacctcttggcttacattataaagattctcaaggacccatattacattaacgagggatgtatatttatggttactggaggaatattttcaacgaggagttcaggaagttctaagtatttggtttagtaattaaatccataaataactactaatatcattttaattaagaaaattaaccctttggctaggattcagtttaattactaaataatcaagttaagacaaatggaaattaacttataaactgctgggtaaattcttctaaaaaggtaggcattatgataatacatgtacattgaagaaagaattccagcataactattactcactttatagaattcacattcacctgaaggttcacaaaatctgctggtatgtcaacatagcaagcacctggacgaccatagatactgcttctcactgcctacgttcattacaagtagaagaaaagatttgtaaaatctcagtcttatcatattctactcaaagataatttaaaactggaaaatgaacacttttcatttttctggacatccttgtggagaaaaaaataattatgatgaaaatcgaaatgtcctctattgactacatttttaaagattttttgtttaaaagggagagagataagaaagtattcatttagggctttaaaattcatgttctattacactttagcttgggaaattattcacccggctctgcctgccaagtttttgcactgtaatatgtactttcatctgcttcctaatcttagtaatctggcagtgttttcagaaactgtgatgctgttacacgtatcaaatggtttctgtaactcctggttttgaaacagctaaaatgtaatttcacgtataaatgctgattataatttataatacaggttgagtatctgtaatccaaaaatccaaaatcttccaaaatgtgaaacttagtgtgtgccaagaagatgatacaggtggaaaattccatatctgacctcatgtgacagctcacagtcaaaatgcaggtgtctaaacagtttattcagcatccccaagggaaaaataatcatcagactatgtgtataaggtacatatgaaaaataaatgaatttcatatttagacttgggtcacatccccaagatgtctcattatatatatgcaaatattctaaaatctgaaaaaatctgcagtcagaaacacttctgaaaagcatttcaggtaaggaataatcaacctgtatgctgtattaattaactaacggagggtcttagagggttttggtttaatcccaattttcaaaaataatcttttgcaaaagcacaagagaaaaggtactcaagggttcattataaacctttctctttacttttgtataattaaaaaggtaattttaaaaactaaaacacaggagaaactttttccaaaaataacttattttacctctctataattaaatgtaatgacagtgaacactaaaatgtaaatagctttctaacaatgccatttttaactgcctgggtatgttcctaattgtcactcattcttttgagaataaaaataacagtaagtatgagcaactgagaaaaatcagttgacttggagagcttgttattaaatactgtaccttttcaataacaaaaggaatagcttctatgctgcttgggcgggcagagaacttggtatataatctacaagcttcaacctacatggaaaatgaaaatcacttaaaattcagctcacaatcatgttactctcctgaaagaagacaaaatgttaagtcattaatttcttttatgtttagaggcaagatggagaaaatatattgcctagactgtcccttaaaagcctattcaaagtacaaagttttgccttggtatgattcaggaagcgtatcataccaaagatgcaaaatcttttggcaaagatgcaaaagtctgataatacccaccatctaacacaacacaggaaaataggcacttctataaactgctggtgagactataaatgggaaaggaagttaaaatctacaaaaaatttaaatcagcatatctttggatccagcaatttcacagataagaatataaaacttcatctgttagattttgttataataataatctattcttacatttctgccagtgttccttttatatactttcttgctatggtgtttcgaatatatgaattcagtagtgataatttttcactgtttaatatatcttgaggcattatatagaaactgtttctcttgatgttttagtatgaaatctatgaaaagctgatagtcccacaggcatgacaaaattaagatcaccctccgattttcagtctatgttcatgccctttagttttaaggacttccacaaaaaccagatacttggattctttctcttctgtttttaaatttgatctaataaactattattttccatttcaggaaaatgcctcagatctatatatcttgaggcattatatagaaactgtttctcttgatgttttagtatgaaatctatgaaaagctgatagtcccacaggcatgacaaaattaagatcaccctccgattttcagtctatgttcatgccctttagttttaaggacttccacaaaaaccagatacttggattctttctcttctgtttttaaatttgatctaataaactattattttccatttcaggaaaaaaatatgtagtggacatttatcctgttttctttttcacgtatatagtttctgcagtaactttagatttccttttaattaacttaatctgctctacttattttccaaacacataagcatcttttaaataactgttatcgtctactattaactaaataaaacttcgattcccttctaagagtataaaaatataacttttgcattaacttatactagagttcagtattttagtttatcatatatgaaattttattttttgaagttctcagtaatgatttctgatttacaaatagactttgtctaatgattttatttatgtatttatttttgagatggagtttcactcttgtcacccagactggagtacagtggtacgatctcggctcactgtaacctctgcctcctgggttcaagtgattctcctgcctcagcctcccaagtagcgaggattacgggcacccaccaccaagcccagctaatttttgtatttttagtagagacagagtttcaccatgttggccaggctggtctcaaactcctgacctcaggtgatctacacgcttggggctcccaaagtgctgtgattacaggggtgagccaccatgcccggctgtctaatgattttaactttgtcctgtaaatgctcaaatatatttatatcttaagtgtcaatcattcactttcagctatttgtttccaacaactgttttttctaaagacacggtatcttggatgggtgtggtggctcacgcctgtaatcccagtactttgggaggccaaggtggtggatcacttgaggtcaggagttcaagaccagcctgggcaccatggcaaaacactgtctctgcaaaaagtacaaaaattatctgggcatggtggcgtgtgcctatagtcccagccacttaggaggctgaggtgggaggatggcttaagcctaggaggtaaaggctgcagtgagccaagactgcgccactgcactgcagattgggcaacacagccatatcctgtctcaaaaaagaaaaaaaaaagaaagaaagaaagacagagataagacctgaatatgttgtacagacatatgtttggtctcaaacatttgggctccagcaattctccctcctcagcctagtagctgagtagctaggaatacagttacgaaccacgtgtccagctttattcttaaaactgtagcattttgttgacatattctttcaagtttcttttaattttgacatgctttctttcctccttctaaaataaaaatatacttgtccagagtctactgataatcattttgagtaagttttttcctcttatttccctaaagtctgggaggcatagtccaaaatcatttttattcctacatcttcttgactcctttaagagcctattttcagagcttaaaatcctgtcacaaaggtgtatttcttgaaagcttgtttctaagcagggcctaagctcacccttaatatccaccctgaagttgtcttatagtagctcaagataattacctttaagttacttcaggtacttctaatttatttattttattttgcaaacaggaggcttttttatatcttctctctacctcttaatggtgtgtatgtattgtgttactaaaatcttaagagttgcaggccaagtgcggtggctcatgcttgtaatcccagcactttggaaagctgaggcaggtggatcgcttgagctcaagagttcaagaccagcctgggcaacatggtgaaacctcgtctctacaaaaaactcaaaaattagccaggcatggtggtgtgaacctgtagtcccagctgcttgggaggctgaggtgggaagattgcttgaggtcaggaggtcaagactgcagtgagctgagatggcaccactgcactgcagcctcaacaacaaagcaagatcctgtttcaaaaattaaaaataaaaaaaaccaaaatcttaaagttggatacctgaggaaactcctggaaagctcccattgtttcttggtttctttcagaggaaccaccaatcacaagcaagggcctgaaacaatcatttttttaacaagataattacaaattagatcatcatgtaaaacactaaacacagtgtctaattcacaacaaataataaatgttaaagggagagaatattatatttttttcttagaaactgtagattaaggctgggtgaggtggctcaccccttgtaatccagcactttgggaggccaaggtgggtggatcacttgaaatcaggagttcaagaccagcatggccaacatggtgaaaccccagctctacaaaaaatacaaaaattagccaggcgtgctggtgggcgcctgtaatcccagctacttgggaggctgaggtagaagaattgcttgaacctgggaagcagaggttacagtgagccgagattgtgccactgcaccccagcctgggcaacagagcaagactctgtctcaaaaaaaaagaaagaaattgtagattaaaaaatatctaagaagcaacctgatatgagagaactttccttaatatcagaaaaagacaaaatgtatagtaaatgttttccttcccttcttccccttccccttttggatgctgacgctaagcttccaggtatattgacataaaataaatttttatgcctttcttattcttgggataaggggaagaaaaattttacactttcctaagtgaatctatttagaaattgcaaaataagtgacattcctcagcaatgaaattcttatccttcaatgtggaaaaaaaaaagatatgggaaaccttaaggtacttaaaaaatataacaccttaaagtagataaagaagagaaagatcaaaaggaaagtaaagaagaaactataagaaacacagggcaagaaagaaaacaatgtcctttccactagaaagattaaatatgttccaaattgattagaacctaacccccctcaacctgatctcactggtaaagtgccagagacggagttaagggcaagatcagagaataagtactaaatagtttatatataaagcaaactaaatgaatataagaatttcaaatatcttcctacctatgcaaaacaaggtgaaaaattagccacattttacacactgagcttggatctttaaaaaaataattcttcacttaaagtaaatagaactacacatacgttcacacatacacacacatattaggaactctaaaatgttaaaagtgtttatggcagctgggtgcggtggctcatgcctgtaatcccagcactttgggaagccaaggcaggtggatcacctgaggtcaggagtttgagaccagcctggccagcatggtgaaacctcttctctactaaaaatacaaaaattagccgggcgtggtggcaggggcctgtaatcccagctacttgggaggctgacgcaggagaatcacttgaacctgggaggcagaggttgtggtgtgccaagattgcaccactgcactccagcctgggcgacagagagactccgtctcaaaaaaagaaagtgtttatctctaagtaactaaattactggtgctttgaattttcttcctaatactcttttttaagttatatctatttaaggtataccatatgatattttgatgtacatatagtgaaatgattactacagtcaagcaaattaacatattcatgttactttttttcctaagatattgtagaaatagtcactttttttggtaaaagtacctaaaatttactctctttgcaaatttacaatacacaatattattaactatggctttcatgttgtacattagatctccaggctttatcgtacttgactgaaactttgtaccctttgacctatctccctattccccctcctcctcctcattccctccccggtaactaactctactttcagtttctaagaattgaaggggttttttttttccaagtctttctaccctagatcagcattagctctactcagtaaaatcctgcagtgacctttttaagaaaatgttttcagtaataataatgtcattaccagcagttcatgtttgcatttgccataccgcccaaggcatggatgagacctgggccagaaacaacaaggcagactcctggcctaaaagcaaaacagaatttattaaaatcaggtcaaatgtaacaactgattcataacactttagtgtgaaacatggcaatcttggacttcaaaggaaggacatacaagtctttactataactgataaaacaattattagaatatttttaattaaaaaacaaggcgatatatatatatcgcgatatatatacatacacacatatacgtatatagtgtatacactatatatgtatatagtgtatatatacgtatatacgtgtatatatacacacactatatacatagtgtatatatatacacactatatacctatagtatatactatatacgtatatatacacacactacatacgtatatatacacacactatatacgtatatatacgtatatacgtatacgtatatatacacacactatatacgtatatatacacactatatacgtatacatacgtgtatatatgtatacatacgtatatacgtatacatgcatgtatatatgtatacatacgtatatatgtatacatgcgtgtatatatgtatacatacgtatatacgtatacatacgtgtatatatggatccatatatacgtatacatacgtgtatatgtatacatacgtatatatatgtatacatatatgtatatatactctgggcaccagagtatactctatatatatgtatacatacagacacacgtatacacacacgtgtatacatgtagacacacgtatacacacacgtatgcatgtagacacacgtatacatacacacacgtatacatacacacacgtatacatacacttgtatacatatacacttgtatatacacttgtatacatatacacatgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcatatgtacatatatactctgggcaagagtgagatgctatctcaaaaaaagtgtatatatacacacacatatacatatatgtgtgtgtatatatacacacacatacgtatatatgtatatatacacacatacacacatacgtatatatgtgtgtatatatacacacatatatatgtgcgtgtgtgtatatatatacacactttttttttgagatagcatctcactctgttgctcaggctggagtgcagtggcatgatcagggctcactgcagcctcaacctcctaagctcaggtgatcttcccaccacagcctcccaagtaaccgggactacaggcagatgccaccacacccggctaattttttgtatttttttttggtagagatggggtttcaccatgttgcccaggctggtcttgaactcctgggctcaagcaatctgcctgccttggcctcccaaagtgctgggattacaggcataagccagcatgcctggcccaaaaaaagaaagatatcggatttcttgtgagaaataaggtacctatcattttcacaccttatgtctctaaccacttattttgatctggactacatctggactaaatcaagttaatggtatacagaagcaaatttttgactgctgagttcatttttgtatgaaaaaaggtttttttttcatttcttaacaaataaatataacgtcgactgatctttgataggaaagtaattctgaatgcagtgctctgcccaaaatgttttgtgtttttttttttgtcttttttttttttttttttgagacgaagtctcgttcttgttccccaggctgcagtgcaatggtgtgatctcggctcactgcaacctccgcctcccggattcaagtgattctcctgcctcagcctcccaagtagctgggattacaggcatgtgccaccacacccggctaatttttgtatttttagtagagacggggtttcaccatgtttggccaggcttgtctccaactcctggcctcaggtgatccacccgcctcggcctcccaaagtgctgggattacaggcatgagccaccgcgcctggtccccaaaatcttttaaaactgaatttgaggctgagcacggtggctgacgtctgtaatcccagcatcttgagaggctgaggcagatggatcacttgagtctaggagttcaagaccagcctgggcaacatgatgaaaccctgtctctaaaaaatataaaaactagctgagtatggtggtgcacacctgtagtgccagctacttgggaggctgaggcaggagaatcgctggaacctgggaggtggagtttgcagtgagccgagatggtgccactgcactccagcatggagacgacagagtgagactccaaataaataaatattgaacttgaatgttttacccttcagtgtgactttctaagcttaaaccactcgggaaaaaggtatctcaatataattcagttcaccattttacacttataaaataatttcttaaaaatttctgtttaagacagacttgaaaataagtaattaccaccaagtaaactaaacttctagaacagtactatccaacagaactttgtatagtaatagaaatgttctgcatttgcagtatgatacggtagccactactgacatggttactgagcacttgaaatgtggctactacaaactgataaactatgatttaaatgttatttaattttaattaatttaaatgtaaacaagtcatacggctcgtggctactatacttgccagtgcagctccagaagttcattcaaacagcaaaaatgttttaaatatgaacttttcggccgggcatggtggctcacgcctgtaatcccagccctttgggaggccaaggccagcagatcatgaggtcaagagacagagaccatcctggccaacatagtgaaaccccatctctactaaaatacaaaaattagctgggtgtggtggtgcatgcctgtaatcccagctactggggaagctgaggcatgaggatcgcttgaacccaggaggcagaggttccactgagccgagattgcaccactgcactgtccagcccagataacagtgcaagactccatctcaaaaaaaaaaaagtatgaacttttaaccattctcttaatcattgttctagcattttttacattaaggcattaattaataactataatttaaatgctttccaagctaaatgaaaagattaaaatatttgtcatatgtaaataaagcggcagaaaacagtgacaatagtgttacttgatggcctatttttttcaggttcaaattcacaagttccttatcacagaaaaaaaactattctggtgaggtctagactttgagaatcttattagtttgcatttcttagcaactgaattactagtttcatttttggaaataaaaaaatgtattaaaactaacatatgtgaaaaaagtatgatacacattcctgtgagagtccaaattctgcttaaaaaatacatagataagggaaaaaactggaagaaaatgaccaattcttaacagttctgagatcataggtgattttcttcatcttttttcctttttttttttttttttttttttgagacggagtctcactctatcacccaggctggagtgcagtggcgcaatctcagctcactgcaacctccgcctcctgggttcaagccgattctcctgcctcagcctcccgagtagctgggattacagacgcatgccaccacaccagggtgatttttgtatttttagtagagatggtgtttcaccatgttggccaagctggtctcaaactcctgacctcaggtgatccacctgcctcagcctcccaaagtgctgggattacaggcgtgacccaccgtgcctagtcgattttcattttcttctttgtgctttctatattttccaagttttccaaaatggacattttaaaaatgtattaatttttaataataaaaagggggtggtagttaggtaacatggatacacactaaaaaatcagaacgtgtggaacagctctcaacagtcacattttgaaccaagcatttttgtattaagtgtgctggggtagttgtgagatccaagacaaggtatcatacatcaactcactatctgatcaccagtgattcactctacaaaatggcaatgtgttccactctgaaacacttctggtatcattattcttttgatgtggtcctcagagagttttaaatgttttttatcctttgttatttaatatatttttctataatctttccaaatgaactcatccttcagctgaaagacgtaatagttctaccccaaaatattaaagtaattgaagtgaaacaaattttagtttacctgcttgtcagatatccaatcgcggaggcagcataacaagcctacgagaaaacaacactgggacttgagcatattgggatccttatagtacatttatgacagcaacttactattaaataatagacaagaacatagtggtaaaggcagaattaaaatatttccaaccttagtaataaatgttctacacataaatttcaaataatggttatctaaattttagtttttcaggaaatttgttcatatgtatgttattcaaaacatcctcttacaattgcttaaatatctgcaggatcaataggaatgtcctcttttattaacaatattggtaatttgttttctttcttttattcttcatcagtctcatgaggggtttatcaaatttatccatcttttcaaagaacaaatttttttagttcttcgaaaatttttgttggtttttctctattgtttgttttctatttcattgatttctgttcttgtatttattatttcagtcattttgaatttgatttgcttttctttttctagcttcttaaaatacaaatttagaacactggtttttaattttctttactaataatttgtttaaaatgattccaagaactgctttagttataggttacaagtttgagttgcatcttttcattatcattctattcaaaatattttctactttccattgtgatttcttcttcaacccattggttaattaggatctgtagtgatacctcctttttcattcctgacattggtaatctgttttctcttttattctcaatcagtctatcttgaagtttattcattttgttaatcttttcaaatatttacaaaataccaaaaagtatgttgcttaatttccaaaggtctgagattctttttagtgatctcttattgagttccactttacttccacatggtcaggtgacatatactgcacgctttcaatccttggcgatttattgagatttcctttatggcctgcatatggatagtttttaccttgtaactctacttcagctcataatcaggaagagagggggcactaaattaaatgcacacaagataacctgggaaaatgctgagtgctctctcaaattcttcttagtctgggacatcatttttttcccagtattatttcttctcatttctttagaaataataatgaattgcgtatttcctagccttcattcagctttaaatgaagtagtatactgtcttaaagaactccacattaacgacataaatgtggaaaaaaaaaaaaaggaaatgtttatggatcataatcttaactggctctactatcatacacccactgagaacctgcacaaagactctgctcttttcctgtgtcgctattctctactggccccatctctctttccttttgcacataaggccaaattcacattaggagaataagacaactcctaagaaatgcaggcatgtaaatacctgctgcaataagaacactttatttagacacccaaaagaattgcccacttatgatagctaggtaagaaatgttgctaggcaatgcaaaatatacaacaacacgtaacaaaaagtatattcctctggtaggaaatgtcaaaagttgagaggtaactgttttgttttgttttattttgttttgttttgttttttttttttgagacagagtttcggagtttcgctcttgttgcccaggctggagtgcaatgatgcaatattggctcacggcaacctccacctcccaggttcaagcaattctcctgcctcagcttcccgagcagctggcattacaaacatgcaccaccacgcctggctaattttatatttttagaaacggggtttctccatgttggtcaggctggtctcaaactcctgacctcaggtgatctgcctgcctcagcctcccaaagtgctgggattacaggcgtgagccaccgcgcctggccataactggttttatgaccataaaagatctgttcctctactaaactacctccattcacaggcagaacagtgtacatggtacttagagagtggactctcgagccaatctgttttgatttaaatcccagcttccccactttctactgtgtaattttggcaagttgctctaaatctctgtttcttcatctataaaatgaaaataattcaaagcactgctgtgaggatgaaatcagttcgtatgtgtaaaacactcaaaatagtgcccacacacagtaagctctcaagaacaatgaacttgctgacaatctgcctacttgctggccaattggtcagtatgtcttgattactctatggatctaatcaaagacaatgaagtcacacccaactacatctttctctttatcacaaacatgtcctgaatgccttagcctgttttcatgttccctctgaatcattctgtcactacccttagttcaggtaccatttaagtcttcctttgactaccatagagtcaggatgcttgagggacatatgcactgggatgttccaccaacatctcaaatgcatgtgttcaaaattgaacatcacctttctcctccaagctggctcttccctctatattcccagtctcagtcacagacaatatgatctacacaatcaatcaagtaagcccaaaatctaggaatcatctccagaggagcctgcctcctctttcctaactggttaatgcctgcttatccttcaggacagctcagacatcatctcctgtgggaagctgagcctgggtactccttctctgggctttatagcaccctggatatctctctatcacagcacttaccaccttataatacaattgtctgtgtctgtctccacagcttggctgtaagccccttaaagccaggaactatcattcatctctgtatccagcacccaacacagcacatgggacctaaagaaccctcaactaagcttataggggctgaaataaaacttagagacagaggtcgtgctatgttgcccaggcagcctctaattcctggacttgagtaatcctcctgcctcagcccccttcgtagctgggattactggcatgtacaaccatgcctcgcatcatctttctgaagtacaaatctaattacatcgcccacctgtttagaaaaacctttagtctcccccattgcctactgttaaaaaaaaaaaaaaattcaaactctttttagatttcccacaacctcccctcaacctacctaccagtctcacagctcaccatgcctttacctaccttgagggaaccacatgaactaacattacctctacaggcaatcttctctgtcctcaaagagaaccagtcaccccttctgtgctactacatctattgtgagagttataatagatgagtctttttctgtaagtcttaccctcaccttccaggactgatcaacgtgaagatcaagactaaacctcactccttctttacatccctctctcctacaggttatgtagcacaatccttagtatacagtacttagtcaataaatgtttgctgtatgaagaaatcagtggcagatatgtcatctctacaaaaacagttaagtataggttccattcataggtcaatagcttcattttttcacacagatgaaagaacagaatgttgttctaacaaagacaagtaaaatgtagaagcaacagaaactcaaaacctcctagttttaagattaaaaaatacaaatctcaaaccttgtagataaagaatgtcattcaataaagaatgtcattcaataaagaatgtcattcaattaataaataatgtataatattaagcatctacaccacgtgaaagcacaaaccaagccaggcactgtggtgatataacaaatgaatcacaacttctgccctccaggcactcatgtatgatggcaaaaggcaccacttagggtggccaggcagttgtttgggcaagaggaggcaagaatttaaattagaaggcaacggtgggagtgtaaagcaggaatatttagcctcagctggactgagagtatgtgatatcacagaagtggattcttgacctttcaagcccgcactactgagagaagagcaaggtggattggcagaggatgcacttaaagtggattgacaaaacgtcgtatcttccttatcctgcttccaaataagcctctaagaaaggtggcagcatgatgtggtggaaaaagcatcaggctaggatctgagccatctgagtttccatcaaggcactaccatttgtgatatcctccaccctgccccgaaccaatcatacaacaaagccttggccttcactcatttatcccacaggtaatctctgaacacctttcttatgcaggcaccacactaagcactgggggtacagatgtgtcgtgaagaaataatatccctgctctaatggagcttgtagcctaatagggaagtcagactttactcataaactgtccattccaatcatgacatacagtatagtagtaagagaatggactcagacccagaatacgtgggttcaaaccctggctctgctactaccagctgtgtcaccaaaggcaagttttacttaacctgtgtcttttctcatctgtcaacttggtgtaacaacagttaatattcaacagtgattgatatgatatatgtaaagtagcagaagagtggtaagcgctatctgggtgtttgcaatgcatacctaccgctattactgatcattcccagtaacgcattcagccacctgagtccatactcaccgcttgctcattcctcatcccgatgtacttgatgcctagctgctgggcagcaatggcgatttcggtcactgggatgcctacgatgccaaatatgtactccacatcctgaggaacgaagaacaggggagtaaactcccaaggccccaccatatcgccacatccttccctccctcccgggcgctaaaaggaaaaccccccgacccccatcgcccatttctactcgtctccaagacaacatcgcggtccccgccagcttccgtaggagcctttcattccaggaaggtccatcgtacttgcgttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtctaaattcgtccacttcccgggagaggtgagaatgtaaacacgcgcgttctccaatcagaactgcgctctcttctcggctcctccattcgcgcgccagaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcaggtacggagggggcgtggtgcggcgcggagggggtgtggtaagggcgtgcggtccagaccccgccccgggcgcccagttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaaggtagtatagagcactgttttctccagcccttgctactaatccatattactctccgctaatatctttccaaaattaggaactatggcgtttcataattcttaggttgggtccctacctacaaccagccctgcacccgatagccttttaaaacatttttgtgtgaaaatcgtttgcaatgtgcaatatctgaaactactgccttggagtcattagaccctctgctcagtgacaataaacataaaatttccaattgtaataaacagtggaacttttaattttttgaggatttggagtcattttaagcaaaaagaacagtgataagtggacagtaaagagatgagaggggagtgggtcatgggtagtgaaatgagtgagaagcactggaagtgaaacgatttctaaacccagacattttcaaactgtagtcctgggtcttttcaaaaggtcttcccctctttttctcaacccctcaaccccaccccaagcagaggagagtgaagtggttgcctccctgcatatgtggacggtgttagtccattttcatactgctataaagaaatacccaaaactgggtaatttataaagaaaaagaggtttaatggtctcacagttccaaatggctacggaggcctcacaatcatggcagaaggtgaaggaggagcaaaggcatgtcttacatggtggcaggcaagagagcgtgtgcaggggaactgccctttataaaaccatcagatctcatgagacttactatcattagaacagcatgggaaaaatcccctccccatgattcagttacttcccactgggtccctctcaccacatgtggggattatgggagctataattcaagatgagatttggatgaggacacagccaaactgttctgcccctggcccctcccaaatatcatatcctcacatttcaaaaccaatcatgccttcccaacagtcccccaaagtcttaactcatttcagcattaactcgaaagtccacagtccagagtttcatctgagacaaggcaagtcccttccgcctatgagcctgtaaaatcaaaagcaagctagtggctgggcgcagtggctcacacctgtaatcccagcactttgggaggccgaggcgggcggatcatgaggtcaagagatggagaccatcctggtcaacacggtgaaaccctatctctactaaaaatacaaaaaattaggcgggcatggtggcaggcgcctgtaatcccagctactcaggaggctgaggcaggagaatggtgtgaacccgggaggcagagcttgcagtgagctgagattgggccactgcactccagcctgggggacagatcgagactccgtctcaaaaaaaataataaaattaaatttaaaaataaataaataaaagcaagatagttacttcctagatacaatgggtgcacgggagtgaggtaaatatacccgttccaaatgggagaaattggtcaagacaaaggggctaaagcccccatgcaagttcaaaatctggcagggcagtcaaatattaaagctccaaaatgatctttggatcattttgacttcgtatctcacagccagatcatgctgatgcaagaggtgggctcccacagccttgggcagctctgcccttgtggttttacaggctacaaccccctctcccagctgctttcacaggctaatattgagtgtgtgcagcttttctaggcacatggtgcaagtggtcagtagatctaccattctggggtctggaggacggtggccctcttctcacagttccaccagcagtgccccaggagggactctgtatgggggctcccaccccacatttcccttccacactgccctagcagaggttctctatgagggctctacccctgcaacaagcttctgcctggacatccaggcatttccatacatcctctgaaatctaggcagaggttcccaaacctcaatttttgacttctgtgcacctgcaggctcaacaccatgtggaagctgccaaggcttcaggcttgcactgtctgaagccaggcctgagctgtacattggccctttttagccatggctggcatggctgggatgcaggacaccaagtccctaggctgcaaacagcagggggaccctggacctgacccatgaaaccatttttcctcctaggtttctgggcctgtgatgggagggcctgttgtgaaggtctctgacatgccctggagacattttccccattgtcttggtgattaatagttagcttcttattacctatgcaaatttctgctgccagcttgaatttctccctagaaaatgggtttttattttctactgcatcgtcagtctgcagatttttcaaatttgtatgctctgcttcctctggaacactttgccatttagaaatttcttctgccagataccctaaatcatctctctcaagttcaaagttccacagatctctaggacaggggcaaaatgccactagtctctttgcatagcaagagtgacctttactccaactctgaataagttcctcatctccatcagaaaccacttcagcctgaattttattgtccatatcactatcagcattttggtcaaagccattcaataagtctctaggaggttccaaactttcccacattttcctgtcttctgagccctccaagtctctaggaagttccagactttcccacattttcctatcttcttctgagccctccaaactgttccaacttctgccagttacccagttccaaagttatttccacagtttcggctgtctttacagtagtgccccactctctgcattaccaattttctgtgttagtcccttttcatactgctatgaagaaatactcaaaactgggtaatttataaagaaaaagaggtttaatagattcacagttccacatggctggagagacgtcacaatcatggtggaagatgaaggaggagcaaaggcacgtcttacatggcgacaggcaagagagtgtgtgcagggaaactcccatttataaaaccatcacagcttgagacttatttgctatcacaagaacagcatgggaaaaaccctccccaatgattcagttacctcccaccaggtaccgctcatgatatgtagggattatgggagctataattcaagatgagatttgagtggggacataaccaaaccatatcagggacccatctcagagggtgacttctttcaagtctcagagtgtatctaaaaagaaaatgcagattttgtattatactctagaatgtatccatattttaattttaaaatgacatttattgagatataataaagatacaattcaatgtccagattttaaatgttagatgagttttgacagttatatatatatatatctatgaaatcaccacccaaaataaaaatgacattttaaactgcttacctgtcaagtaaaattgacattccagaaagatgtgaaacgggctgggcacaatggctcatgcctgtaatcccagcactttgggaggccgaggtgggcagatcatctgaggtcaggagttcgaggccagcctggccaatgtggtgaaaccccatctctgctaaaatacaaaaattatccaggtgtggtggcacatgcctgtaatcccagctattcgggagactgaggtgggagaatcgtgtgagccagggaggtagatgttgcagtaaaccaagattgcaccactgtactctagcctgggtgacagagcgagaccctgtctcaaaaaaaaaaaaaaaaaaaaaaaagatgtgaaatcatctttgcactttgagtagtccttgacacaatgcctcctgtccttgttgaagaagtacagacttccccttccatcatgtattatttatatcagtaccttttgtgacagtctctgcccctgttgcattagagtcacttggaaagctttttccaaatagttacttgggccctaccccagatctcctgaatcagcatcttaggacaagtcaggcacctgtattttttaaaagctgctacctgattttgctttgcagcccagagttgagaaccctagctctgttttcatgccagaagcatgagttactaattaaacatatgattgcctgtcaccaaagtaatactgttgattaatttggattgacaggttcaagactgatttgacattgacagaacaagctgtatcgatggtagtcagttcactgggcctacttctgtgtcaaaagaaacagtgacagaaccactcagtatgaagtgcaatgaaaactgaactctgaattggaacaaataactggaattcagttaactggttttgcaaaaggataaatactcaactggttgttttctgccatttaacaaagagaaaaatcattgggattgtttaaacttgctttcacctttgcacctttcagttcaggatgcagtgttcaattgttaacttgggcttgatgattcagcagaaagaaatgatttgagttctggctcactggattaacagggccaaggagcaagtcctttgcaatccaattgtaattacagccagcttgtccaacccttggcccaggatggctttgaatgcggcccaacacaaattcataaactttcttaaaacattatgagatttatgcaccgacccttttttttgttgttgtttttggtttttttttttttttttagctcatcagctatcatttgtgttagtgtattttatgtatggcccaagacaattcttctttttccagtgtggcccagggaagccaaaagattggatacccctgacaggattccaggattcttttgtaatttctcagaggccctctgtgcatactccgtaaggactatccacattctttattactttcattggcaataggtataaaattttatttgttggatattttactgaaatgttacttgtttttgcttatttactgattggtgggaggaagtcaaaggatgaataaatctaacctttttaaaagaaaaggctaaaatactcataacatgctctccaaagagcagagctagtcatcaaagaatctgcataccaattactctatttgtaggttctggatttgagattatgaaaaagagcaaattggtggttttcttctctctgggccagggagatatccaggcaaccaggtaatttagtaagaattgcaaatatagtgcctggagacaatttattctctaaagactgcagcttctacaggcagtaactcttaaagcccccaaattgggatagtgcattttaatttccgtatactaacaaggacactaaaaatccttgtgattattttaaagcataacactagctgaacttgtgattaagtattctcacaaatgtattatcaaaatgtgaaatgtttacttatcaaatgaggaaatgaatcaaggtcatttgtgatacattatagaagctaaaaatgaaattgcctgacataagataaaactgatactgaatatcttaaaaataaaaaggcggaaacaacaaaaaaaggagtctatgtagaacactattttttatagcaatgcaaaaactgtacagccggaaatgtgttgtaggaaatatgtcaacataggaagtaaaataatgtaatgaaaaggttctttgaataaagtgggttaaattgattttctttgcttctcattaaatctgtggacttcagagtaccaaagctcagcaacaggcttgaaacaaacccagtgaaaagcaactttattattgagctgaggattgatatcagtaataactcattaataaaaaagcttgataataaaaactcccagtgcctgatgccagctgacagacactgggagttttcccaggtaccctgtgacctagagaaagcttggattcctgcctttggcttgggctggcaagccctgtgcctttactctacattttaatgccagggagacctggaactggagaagggagtgctgtgggaagaaaacagaaggaatgttgttcccttgttttagctttgtgttcatccattatgggttttgggtttttttgttttttgtgtttttttaagaacatttgagatagtttgacagcagcagtcattacatcactgacgaggacgtttacttgtgtaaaatgcaccaggaaatagtgacaactgtatgttgtgctatgaggatgtaagagatttatctcaaatggcttagaaatcaaaatataggtcagtgcggtggctcacacctgtaatcccaacactttgggaggccaaggcaggcggatcacgaggtcagtagattgacaccatcctggccaacatggtgaaaccccgtctctactaaaaatacaaaaattagctgggcatggtgatgtgcgcctgtaatcccagctaccggggaggctgaggcaggagaaccacttgaacccaggagttggaggttgcagtgagccgagattgcgcccctgcactccagcctggcgacagagcgagactccgtctcaaaaaaaaaaaaaaaaagaaatcatagtatttctccgtatgatggaattccatactcgggggagtgtcccacagggtaggcaagcagctatcacccatgtaatatggtactagtgttgaaatattttctgttttcacttgcttcttctgccattagcattcattacagccctttcctttaactttttaatttgtactttattgctttgttttgataataatctattctccatgtcagcaaaacaaagatttatctctagggaagaatctctgagtgattcccagggtttgggggttgaactggggacatcttcatgatgaacttaagcccttaaacttctttttacatcataacgtttgagttcttctttggagcttagctgtgatttattcttttcacttcaaaaaaaatacatttaacatttatgacatctttcagacacatgaataggatcagagattaatatacacccatgtacccagcccctggcttaagaaatacatcacaaatataatgaaacccccgtgtgtcctttccccattacacctcctttcctgtcctacagaggtaaccactatcttgaatttggtgtttgtagttcccacattatccattctttagatgatcgatatttggtcatttttagtttttttggaaacagtgtgctctgaaattcttgcatgtttccttcttgtgcacatgtgtgagagtttctacatatatatcaaggtggaggtcatcatcatttgatctccaaagtattgtaccaatttatactcccaacatttgtgtatgagagctaccctttctccatagtctcaactgtggagctttaaaaatttttaaatgtgaaatggcttctcagttccatttctctgactacaaatgaggttaagttatatttgtatatatatattggccatgcgtgtttctttttctgtgaattacgtgtttacatctgttgcacatttccttattggattatcttttgctttttgatttgtagatgtcctttatgtattctgaatgctaattatttgtcttttaactttgttaatagtgattttagaggtataaagggtttttttatagtcacatttgacaactggtcttccttattttttttttaatttttttatttttttggtaacttgctaaagaaaactttttgtaacctgaggttatgaagatttttttctatatcaaaaagtgtaaagttttatttttcatatttaagtcactacctggaattgatttttgtttgttgagaagtaagaatccatataatatgtcaattagatttgctgtgtaattaaccaccccaaaacttagtggcttaaaagaaccaccatttatttaacatatattcctatgaggctggtctcaactgggctcacccatgtatctgttagtcagttgccagtgaactgagtcactcagcccctggaggttagctggttgtccactgggatagcgggcatattgccagtgagccacatagctctaccactcagcaggctagctggacttcttcattggatggcagcaggttgcaaaagggaatgagcctcattgtgcaagcctctatgtgcggtgtttgctaacatctcattagccaaagcaagttatgtggctgggctcagactctaagttaaaggcattcgagttacatgataatggaacatggatacagagaggggagaaattgctggccttttttatagtcaatttaccataacatccagttgtccaagcaccattcataatatagttcattctcatcccagtgatacataatttcccctctgtggaatgtcaagctcgcatatttatgggagtatttctgtactctctgttcttttcctatcctaacaccaatcccacactatcttaatttctgtgtttttaaaataagtcttgatgttggtaggacaagtagtccctggacttcattcttttgaagccatcttgtttattatattaattttaagcaactagaggggatggaagaggaacctttagattaaaagagatttaaaagatagggtattttttaatggacaagactaaactacagtgtctagggatgcacattgggtgataaagctattttaaaaaacaaagaagtgatgagtataaaagtcagggtcatggttacttgatccctcatgggtaatgttgtcagatttagaaaaaaaaaaaaaaacaggactccaaaactcccagttgaatttgaactttagatgaacaatgcataattttttttagcgtaagtatgttccaacatatttatctgaaagttaaatttaactgggccacctgtattttacctggaaaaatcctgattttattcaaggtgataatgcagtttacattgcccagccttccttgtagctaggagtggtcacgcgtccacacatgggccaaagcaatttaaataggagtcactgggcagggcttttaggaaagctgatgaaactggcaagtaccctctgtactcttcctctgtacaacatgataattggagttgtagaagtcattttggaaccacaagatgactctgaaaatggaagctacatgccaagaagttaggcccagaaagagagggatcctgggtcctacatgactcttgcctttgtcaggttttattatcagatttttatcacttcataagaaaaaaatgccttcttttactatattctcacacacattgagtagcattaggattattttttcctttatagttagaaagaattcttctagaaactatttgggcctgttttgagggtggagaatgggagggaatgattgtttgataactatttcttctatgattgttggcatggtttagttttttcttttatccgaagttttggtaaaaatatatttttcagtcccagctactctggaggctgaggcacaaggattgcttgaatccaggaggcagaggttgcaatgagctgagattgcaccactgcactccaacctgggtgatggcgtgagacagtctcaaaaaaaaaaaagaaaaaacaaataatgtattttttttctaggaaactactcgtctaaattttctagcttatcaatataggattgaatgaggtgattattcttttttaaaaaaaattcttctgcatttatagatttctctttgttttgtatatttgtttctcttttttttcttaattaggctagccgatcatttgtctttacctttttttttctctaaacaacaactccttggacatacttattcattctgtcatttttctgttttctaatttaatttccactcttatttttatttccttccttttgctttcttgagcatgccattactcttttcctcactgttaccaccttttgttagttttacaatttctacattgccagagttaataacatttgcactgtgttctataaatataatcctcatgtttattttacattcaaggctcttgccagtttttccattcacctcttaattggccgaagattaccctctatgcattttttcaaagaaggctgatgagactgatgagaataatagtccctgagttcttatattttcatacctattatctggtttttttctttacttcaaccataggttggcataatatataatttctggcttatattttattttctggaaggattctataggcttttactggcattgatgttattgtagtaaagtctgaggacagcctgattattttgcccctaataaatacccttgatctttttatttagcttcccaaatgattcttactttatctttgaagatcaagaattttgctaggctatctgccgatgttgatgttctgttcctttctttcttgagttttgctatctcttttcaagctataaattgaaatatgcttttatttctggtgagttttcttcaattacatctttaattttttttttttttgcttcattatatgttgtctattgttgtataaaaatttaccctacgacctattcagcagcttaaaacaagacccatttattatctcaaagtctctatgtgtcaggagtctgagcatagttttactggatcctctggtcagcatctcacaaggctacagtgaagttgtcagctgacctcatggtctcatctgaggctgagttttcttccaaattcaactgatcgttgaaagaatgaatttccttgcagttgtagtattcatggtggcttgcttcttcaaggtcagccggggagagagtgtgtctgaaatcttggagcaccccagttctttttttaaagacctgattaattcagacccaccagggtaatctcttttgattaactagattaactggcttgggattttaactacatatgtgaaagcccttcacctttgtcatattctattggctagtaacagagtacaatttccacctgcactcaagaaaagaggattatacaaggagtcaccttagggtgtgtccaccacacattatttttttcttttatgcattttccaattatgcatatgatggatctcgttcactgttctccctgtctatcattttctgtggactccttttcaattctgtatttccattcatgttgcttatttatttacagcatcatctgatttcttttgctgcttctatctttgccataatttcttgatgttttaattttttcttctgcttctttcctgagccctgccagataatatttcatctgtctcccagctttctattccccactcccttctcccttctctcttcttccctcttccccctccttaccttctcctcttctcctcctttcctccccttctcccctttttccctttcatcttttaattctcttggtctattttgtgcttttatttaatataagcagttttttttcactcgtggcagaatgttttgtcacagtttttatttgtgttgtggcaattttctggggtataacctttgttttcgtatagtatctttcaaaagatcttgagctttttatttactcatttttgagtgagtttttcctctactgtaggaggtttatgtgtgaacaaggccattctggttcacagttattttttcttagcacatttaagattttgttttcttacttctattgttactcttgaaaagtctgctgttttcaaatcaccatatctttgaaggcaatctctcttccctctggttgcgtctaagatttttttcttcttcaaatatttcgtgttctggtttctttatgttgtgtatagatttctttttggttgtcttgaatctatggatttctgtattttattattaaaattctcacctattataccttcaaacatgtgtaatgtgtcatgtgtcattttatgtattttctccctctttctttctttcttttttttttttttttaagtcaaggtcttgctctgtcgcccaagctggagtacagtggcacagccgtagcccactgcagccttaaactcctgggctcaagcaatcctaccacctcagcctcttgagatgctgggaccgcaggtgtacaccaccatgcccagctaatacttttttactttttgtagagattatattgcccaggctggtcttgaattcctggcctcaagtgatcctctcatcttgacctccaaagtgttgggattacaggcatgagccattgcacccagcctctattttctccttctgaaattccaattagaaatatcatggaacatcatatatgtcttccatgtctcatcttctttttttcccttttgtcatctctgtggtacattctaaacaaattttttaatgattctaacggccatgccacaaaatgtctccatttggttttatttgacaatatctttttctttttttttttttttttgacacagagtctctctctattacccaggctagagtgtagtggtgtgatcttagctcactgccacctccgcctctgagctcaagcaatcgccctaccttagccacccaagtagctgggactacaggcatgcaccaccacacacagctaatttttgtattttttgtagagatggggttttgccatgttgcccatgctggcctccaactcctgggctcaagttatcttcctgccttggccttccaaagtgctgggattacaggcatgagccaccactcccagccaacaatatcttattcttttacctgttttagagtcctctgagtacttctttaatcaacttcagtgtacttatttgaaaattttcactagtaatccttccatctgaagttgttgggggcctgattttgctgtattctttaactttcttgcataatatttgcttccttgtgtgttttgtaattttgaattttgagctcttgtttaccttgttcttcaacccaggacactcagtcttcaagaagagagtatgtggataggcttttccaggcatcttaggactgataacatctcaaaatcactttgtgctcatttcttggcatagagttacctgggtcatgtatgttgtgagtttttgaatcatgaacccacataaggaaaacctttgattatgttggttatgactttcaaggagtactattttcccctgctcagagcccaagatgagatgtacaagtttctacgtcagatagttactttggcaggcaggcagatatttgtttttgtccatcctttcaataaaggaatcattccttaaggttcctagctatatgcacagatctcactccaacctccacatcttgtctttctgtccttcatggtctttaaaatctaaaccccttggatatcaagattgggacatgttccagtatcacctcaccactccagttttcagttacttgattttagtttttattttttaaatgctttttttaaaagagaagttttatgctcacaataaaattgagcagaaagtacagaaagtttacatatactccctgtcctgatacatgcatagccttccctgttatcaatatcccagactagaatggtatgtttgttataatcagtgaacctgcattgacacattattataacatgaagtccatagtttacattaggattcacttctttctcccttaacacttggcaaccactgatcattttaccatctctgcaattttgctttttccaccactggaaatgttacatattggaatcatacagtatgtagcctttacagattggtttctttcctttagtaatatacatctaaggttcctccatatcttttcatggcttgatagctcatttctttttagcactgaataatattccattgtctgaatgtatcacactttattaatccattcacctactgaagaatatcttgattgcttccaagttttggtaactatgaaaaaaactgctataaacactcctgtgcagtttttttggagacataagttttctactcctttgggtaaatacaaagaatacgattgctgaatcatatgataagagtatgcttcattttgtaagaaaatgccaagctgtcttccaaagtggttggatcattttgtgttcccatcagcaatgaatcagacttcctgttgctctatattctcaacagcatttggtctttttaaaaattgttttgggccgggcgcggtggctcacacctgtaatcccggcaattttgggaggccgaggtgggtggatcacctgaggtcaggagtttgagacaagcctgaccaaaatagagaaaccctgtctctactaaaaatacaaaaattagccggtcgtggtggcaggcgcctgtaatcccagctactcgggtggctgaggcaggagaatttcttgaacctgggaggtggaggttgcagtgagccaagatcgcaccattgtactccagcataggggacaagagcgagacttcatcttcaaaaaaaaaaagttttgtttttttcctttcaccaaactaagcatttagtcttgtcagtgttttggattttgactattctaataggtgcatagtggtatctaatttttaatttgcaattcccttgtgacatatgatgctgaacatcttttcataagtttattgctatttgtgtatcttccttggtgagatgtctgttcagatcttttgcttattttattttatttatgtatttttttttcgagtctcactctgtcacccaggctggagtgcagtggtgcaatctcggctcactgcaacctccgcctcctgggttaaagcaattctcctgcctcagcctcccgagtagctgggactacaggcacgagccaccacacccagctaattttttgtatttttagtagagacgggggtttcactatgttggctaggatggtcttaacctcttgacctcgtgatctgcctgccttggcctcccaaagtgctgggattataggcatgagccaccatgcccggccttttgcctattttttaatcaagttgtttactttcttattgttgagttttaacagttctttgatattttggataacattcctttatctgataaatcttttgcaaatattttctctcagtctgtagcttatcttcttctgttcttgatagtttcatttgcagatcaaaagttttacatttagtgaagtgcagtgtatcaattctttcttttttgtccaacacaagatcatctagctattctcctatgttatcttttaagagttttatagttttgtactttatatttagatctatgatctgttttgagttacttcttgtgaagggtataagatctttatctagatttgttttttacatgtgggtgtccatttgttccagcaccatttgttgaaaagactgtctttgctccatcacattgcctttgctcctttgtcaaagatgagttaactatagcctggtgtgcagtggtacacacttgtagtcccagctgctcagtagagttcaatagttttctttaggaggctgaggtagaagaattgcttgagcctaggaatttgagtccagcctaggcaacatagcgagacctcatttgtaaaataaataaataaataagaccagttgactgtatttatgtgggtctatttctggattctctattctgttccatctatttgtctgttctttggccaattgataaaatatcatgttgtcttgattactacagttttataatgtcttgaagttggtagtgtgagttttctgacttcattcttcttcaatattgtattggccattcttggtcttttacctctccatgtacaatttatttttatgtatttatctagagacaggtctcgctctgtcatccaggctggaatgcagtggcgtgatcatagctcactataaccttgaactcctgggatcaagtgatcttcccacttccatctgctgaatagccaggactataggcacacaccgccttgcccagctaacttaattttatttttaattttgtagagaatggggtctctctattttgcccaggctggtggtctcaaactcctggcctcaaatgatcctcctgccttggcctcttaaagtgctgagcttacaggcataagccactgctccatatgcagtttagaatcagtttgttgatacctacaaaataacttgttgggatttcagttgggattgtgttgaatctatagatcaagttgttcgcaagaactgacatcttaacgatattgagtctctgcatttatttagtgctgctttgatttctttcaacagagttttgtagttttttcatgcagaccttaaacatttttaaaagatttatacctaaatatttcatatgtagggtacgaatataaatagtattatggtttttaaaatttttttcttttttatttttttgagtctcactctgtcacccaggctagagtgcagtggtgcgatctcggctcactgcaagctccacctcccgggttcacgccattctcctgcctcagcctcccgagtagctgggactacagacgcctgccaccacacctggctaatgttttgtatttttcatagagatggggtttcaccatgttagccaggatggtctcaatctcctgacctcgtgatccacctgcctcagcctcccaaagtgctgggattacaggcgtgagccactgtgcccagccaatagtattatgttttaaatttaaaagtccactgttttttgctgatatatgagaaataaattgatgtttgcatatgaaccttgtatcctacaacattggtataataacttattagttccagatattttttattaattcattccaattttctacatcgatgacaatttcatctgtgaacaaaggcggttttatttcttctttcccagtttgtgtatcttttctttgctttttgcattagctaggacttacggtatgatgttgaaaagcagtggtgagaagggacatcattaccttgctcccgatctttgtataaagtctctagtttctcaccactaactgtgatgttagctgtaggtggttttttaaatcaagttgagcaagttcccctctattcgtagtttactgagagttattatcattccaaatgggtattgtacttcgtcaaatacatctatttgacatctatttttctgtgtctattgatataatcatgtgatttttcttttctttttttgagacagggtatcactctgtcacaccagctggagtgcagtggtacaaacacagctcactgcagcctccacctcctaggccatgtgatctttcttatttagcctgttaatgtgatagattacataaattgattttcaaatattgaaccaacctttcatacctgagataaatctcacttagtcatggtgtataatttcttctatggattgttagattcaatttgctaatatttgttggtgtaaaagtcattgtggtttttgccattgaaagtaatggcaaatgacttttgcaccaacctaaggattttgctaaggattattgcatctatatttatgagagatattgctctgtagttgtattagtctgaattctctagggagatactgggagaacccacccccaatatttcaacgtaagttctattttccataagtgtcagctggctgagaaataaagagagacagtacaaagagaggaattttacagctgggccgccaggggtgacatcacatatcagcaggaccatgatgcctgcctgagtctcagaccagcaagtttttattaagggtttcaaaaggggagggagtgtaagaacagagagtagatacaaagatcacatgcttcaaagggcaaaaagcagaaccactgataagggtctaacaaagatcacatgcttctgagggaacagggcaaagggcaaaagcagaaccactgataagggtccaacaaagatcacagggcaaagggcaaaagcagaaccactgataatggtctatgttcagcggtgcacatattgtcttgataaacatcttaaacaacagaaaacagggttcaagagcagagaaccagtctgaccacggatttaccagggctgagttttcccaaccctagcaagcctgagggttctgcaggagactaggacttatctcaatccttacctcaactgcacaagacagacattcccagaacggccgtttatagacctccccccaggagcgcattcctttcccagggtattaatattaatattccttgctaggaaaagaatttagcgatatgtttcctacttgcacatccatttataggctctctgcaagaagaaaaatgtggctcttttagcccaaccccacaggcagtcagaccttatggttgtcttcccttgttccataaaaatcgctattattctgttctttttcaaggtgcactgatttcatatttttcaactacacatgttttacaatcaatttgtacagttagcacaattatcacagtggtcctgaggtgacatacatcttcagcctacgaagataacaggattaagagattaaagacaggcataagaaattataaaagtgttatttgagaactgataaatgtccatattaagatgaaatcttcacaatttatgttcctctgccgcagctccagctggtccctccattcagggtccctgacttcccataacagggagacagtgccaatgggatatatatagagagatatacgaaagagatttattagaggaattggctcacacaattatggaggctgaaaagtccaataacaggccatctgcaagctggagaccctggaatgtcaatggcataactcagtccaaggccgaaggcctgagaacccagggggctgctggtgcaagtcctggagtccacaggccagggagttctaacacgcaagggcaggagaggaagggtatatcccagctcctgcagataaatcaacacacttgctttttctgttttcgttctctcttgtctcttggcttattagatggtgcctgcccacattgtgagggtggctcatctttacctagtgcacttagactcacacactcatctcctcatgctgatcacaagcacatccaaaagtaacattttaccaggtttctacagtgttccttaatccattcaagttgacacctaaaattaatcctcacagtagttttcttttcttgtaatgtctttgtctgtttcagtattggggtaatgctgccctcatggaatgagttaagaagtattccctctgtttctgtcttctggaagacatagtagagaattggtataatttatttctgaatgtttggtagaattcaccaatgaacccacctggactgggtgatctctgttttaaaatattttgaattattgattcaatttctctaatacatataggcctcttcagattgtctgtttttcttgtgtgagttttagtaaattctgtcttttaagaaattggttatcattttcttttttttttcctttgagatggagtttcgctcttgttgcccaggctggagtgcaatggtgcgatcttggctcactgcaacctctgcctccctggttcaagcaattctcctgcctcagcctcctgagtagctggaattacaggtgcccaccaccacgcctggctaatttttgtatttttagtagagatggggtttcaccatgttggccaggctggtctcaaactcctgacctcaggtgatccacctgtctcagcctcccaaagtgctgggattacaggcgtgagtcactgtgcccggacatcagtttcttaaattgacatctaggttatcaaattttggggcataaagttgtttataatattcctttattattctttcggtgtccatgggatctgtagttatgtgccctctttcattgctcatgtcagtaatatgtgtcttctctatttttttttcttagcctggctagaggcttattgatttttcttgatcttttcaaagaaccagaatttagtttcatttttctctattgatctcctgctttacatttcattgatttctattctagtgtttattatttctgtcattcttcttactttggaattaagttgctcttctttttctagtttcttgaagtaaaactttagactactgatcttatatcttaattcttttgtacatttctcttgagatttcttttctgacccatttgttatttaaaactgtgcagttttatttccaagtattttgggtatttcttgctaaatttatgttattgatttttagtttaattctactgtggtctgagagcagatattgtattatttctactcttttaaatctgttaagttgtgttttatggctcacagtgtgttttgtcatggtaaatgttccatgtgagcttgagaagagtctgtactttgctgttattagatgaagtagtctatagatgtcccttgtatacagttgattgatggtgctactgaattcaactatgtccttactgattttctgcattctggattttatccattactgatagaggggtgttgaagtttacagttataatagtggatacatctgtttctctttgcagttctgtccatttttgcctcatgtattttgatgttccattgttggcacaatgcacattaaggatttttatttcttgttgaattaacccctttatcattttgtgacccactttttaatcctgataactttccttggtctaaagtcagctctgtctgaaatttatgtagctattcttgctttctcttaatgactatgttagtctgttttcatgctgttaataaagacatacctgagactgggtaatttataaaggaaagaggtttaatggactcacagttccacatggctggggaggcttcacaatcatggcagaaggcaaatgaggagcaaaggcatgtcttacatggtagcagacaagagtttgtgcagaggagcttccatttataaaaccatcagatttcatgagacttattcactaccatgagaacagtatgtgggaaaccactcccatgattcaattatctccacctggctccacctttgatacatggggattactacaattcaaggtgaaatttgggtggagacacagccaaaccatatcagttactattaggatggtatgtccatccatttactacacaatctacatgtgtctttataaagtgggtttcttgtagacaacatatagttgagtcatgttttttatctactgtaatgatctcttgtttcgaattgatatatttataccattgacttttaaagtgattattgatatagttggattattatctatcatatttgttacttttttctacttgctgcctttgttcgtagttcctgtttttgtcttccagtctttttctgagttttggtgttttaattgaacattttatgtgattttgtcacatgattttgtctgaaagtatcttatttctctgcttttgaaggttaattttgtaggatgtttatatggtttggctctgtgttcccacccaaatctcatgttgagttgtgtggcctggtgggaggtgattggatcatgtggatggtttctaacagtttagcaccatccctctagtgttgtgtcatgatagagttctcatgagatctggttgtttaaaagcgtgtagcacttcccacttagctctctccatcttctgccaccatgtgaagatgtgcttgcttcccctttgcccttctgccgtgattctaagtttcctgaggcttcccagccatgcttcttgtacagcctgtggaactgtgagtcagttaaaccccttttcttcataaattacccagcttcaggtagttctttatagcagtgtgagaatggactaatacagacgcacaatgctaggctggtacttttttcctctcaacactttaaatatttcacatcactgtcttattgtttacatgatttctgagaagtcagatatctttcttatctttgctcctctatagataagatgttttttccctctggcttctttcaggattttttctttatctttgcttttctgtaatttgaatatgatttgcctacatgtagatttttttattttttattttcgtttttggcagttaacctgattggtgttctctgagcttcctgggtctgtggtttagtgtctgatattaatctggggaaattctcagtcattattgcctcagatattgcttctattctttctccttctggtattcccattgtacatatttataacttttgtagtccactgtttgttgatttttttctttttttcagtcttttttctctttgcttttcagttttgggcatttctattgtcatattctcaagctcagggattccttcctcagccatgtccaatctactaatgaatccattaaagtgattcttcatttctgttagtgttttttaatctcaggcatttctttttttattctttcttagaatttccatctccctgcttagattacccatctgttcttgcatgttggctgttgttttttttttcagtagagcctgtggcatattcatcatatttattttaaattgctagtctgataattacaacatccctgccatatctgactctggttcttctgggaggttttttgagacaaagtctccctctgtcacctccctctgtcactgctggagtgcagtggtgtgataacagctcactgcaacctccgcctcctgggttccagcatttctcgtgcctcagcctcccaagtagctgggactataggcgtgtgccaccaagcctggccaatttttgtatttttagtaaagacagggttttgccatgttggccaggctggtcttgaactcctggccttaagctccttagcctccctaagtgctgggattacagccatgagccaccgcacctggcctaactctggttctgatgcctgctctgttttcaaactcaattttttaccttttagtataccttgtaattttttgttggaagttggactcgatgtactaagtaaaggaacagcagtaaaaaggcatttaattgaaatgtggtgggagggaatgtgttctattgtctttagggatctttagggagcctgtgtttatggactgtgaactttacaagtgcttctcagcccccaaccccactcaggcgggacagaatggggctagagttgggtatttcccttcccccaggtcagttaagctttgataaaaccccaataggtaaaaatagtttctctggaggagaggcctgctaaagaccagaatgctttgtttcctttccctcttcctctggcagaagcatgggaggatttttttctccagtcttcattgtgagaacctggtagaactcctagaggtaaaacctacaaaagtgcgggtgcctccatctaagactgggtccctctggagttgttttttgtttgtttgtttgttttgttttgttttttctgtttgttttgagacggagtctcactctcatgccaggctggagtgcagtggtgcgatctcggctcactgcaatctccacctcccgggttcaagcaattctcctgtctcggcctcccaagtagctgggactacaggcacccgccccctcgcccagctaattttttgtatttttagtagagatggggtttcaccgtgttagccaggatggtctcgatctcttgacctcgtgatctgcctgcctcggcctcccaaagtgctgggattacaggcgtgagccaccacgcctggcccagttttaattttttattttgcatataagttcaaagccttccaaagtgtttgtttatgatttattttcttgttaaaatctgttcttgttcattgcctgtttataagtgttgtcttgatgtttattttttgcatgtacattttaatttgtcaatctgtttcttcttttatttcaactgttccaaattttagaaagttgtttcaagtatctgatacctaattctaatttatgctagcttttctaacatttgatattcaacttctgattttgagtttatttttgtgtatggcctaagatgctattattcctgttgttattcatccatcccagtatcatattcaatcaacctcccccaccaccaccactattttgagtgtggttgcattaaaaagcatgtgggcttttggtcagaatagatttgggtgaaatcctggctatgggtagcagtctccttctactttaagagtaacttcttcacaaaaggagctagatgatcctctgctttgcctctaatgctgaggaatgttgcacctacaactatcatggaagacgctgaaacctccattacccaatcctgtactcccagcaccctcagggagccccacctctggaggactcagacactcatgccaggtaaagctgtaggacagaggccaggcatggtggctcacagctgtaatcccagcactttaggtgagaggattgcttcaggcctggagtcgagactagcctgagtcacatagcaagaccccatctctacaaaaaattaaaaaattagtcacacatggtagcatgcacctgtagtcccagctacttgagaggctgttggggagggatcacttgagcctaggagtttgaggctgctgtgagctatgtatgatcatgccactgtactccagcctgggcaacagagcaagaccctgtctcaaaaaaaaaaaaaaagaaaagaaaagaaaaagaagctataggacataggggagctagtcatatgtctgtcctactgagactctagatggcacaaggcaatggcacttgtgttagaaccagaatgcagctatggctgacttggaaccgtctgtcagaggaaaaaaggcatgcaaatagttactcatttgaccaaagcagaagaaaaccaaaatgtccaatgcctccaggaagaaaggcaaagatagagatactaatcatttctctacacatctgccatgccatgggtgaagaagacagccaagttggtgaacagatctggaaaggttaccatcattcttgattgagctctgccctccaaccgaacacccctgagcagccacggcatgccggctcaccgtgcttcccaccacgcatggatcaagagcacctccacaggttctcagaagctacggcaccaggacccatttgcctgctttttgctgttcctcttaagacagggtcctgcaatcacagctcaccgcaacccctgcctcccaggctcaagtgatgctcccatctcatccttccgagtagctaggactacaagtgcatgccaccatgcccagctaattaaaaaaatttttttttggtagagacagtgtttctccatgttgcccaggctagtttcaacctcctgggctcaagcaatcctcctgcctcaccctcccaaagtgttgggattacaggcattagttactgtgcctggcctctcttggtaattttgactatgccactcctaaatatatgcctcttggcctctgcatgagagaaggtggcctttgatgtgttatttccagcactgtggtttactttagctttttaaattgtttctttcataatttctactatcatccagcgtcagtgtttctagcctatcctattaagggttattcttttgttttgttttgttttgttttttgagatggagtttcgctcttattgcccaggctggagtgcaatggcacgatctcggctcactgcaatctctgcctccgaggttcaagctattctcttgcttcagcctcccaagtagctgggattacagtgcctgccaccacgcctggctaattttttgtgcttttagtagagttggggtttcaccatgttggctaggctggtcttgaactcctgacctcaggtgatctacccaccttggcctcccaaagtgctgggattacaggcatgagccaccatgcccagccccaagggttattcttttgatttggggaacagggttccttggccctattacccaccacattgttctccactctttgcatcctgagcatctccatctgcatttttcactcctgagtactggcagagatgagcacaagggtaatgggacttgatgtagtgacattgtatccaccacatgcttagagaggttacatccaccacaagcttagagattctgtatccaccacaggcttagagaggttgtatccatcatacagttatgttgcatccaccatacatctagagatgttgtgtgcactatacaatcagcaatattgtgtccatcatacatttaataatcacaaagccattacatggcccacatttctgagcacatcttccctgaaaattttgacacgtagttctaggacatcacattttccatgcactggttctttttcttctggatgtcaagccctcaggtccacattatctagaaggtgttctttaaggtagtccaagaaggaaatgggtaagaaatttcccaaaggcttttaaaagcaataccttgctgacactcattgaaactcatttcagagaatttgacgatggtttttggaagccataagcattccagaagaacagagtagctagaagtgcccccaccattcatgtgtcccaggactgactgacagtggaaaagctttatgtgtgtgtattttccttgctgcctggtcaaggtctccaatcaatagtttaagactttttcacagttcattttcgaccaccgaagatttcctttaactttcctgcaaactcaaatatgcatttaaaaataatctgtttcatttttgcaggatatggttgaaacatttttcagattatctagtctaccatattgccccccacctttttttaaatcaggaattttatttaagtaaaaaccaataacaacctggttcttcaatggtattcctgccatagctaagacaagcactgagtcctttaactgacctgcatcaaattgtttaggggagatttttccttctagtttgagtgtttaatgctttctttgctgcttattttcattaaatatggtagaaatactttgaaatctgcccagattccatcagccctattggagaggcacctgagaaatgaagatgatgtttctgactcataactttctttgacataagggaacaataggagtcagaatataggatatacattcctctatcttctactcaattggttctccaagtgtgactcagaccaggagcatcagcatcaccttggaatttgccataaaatgcagattctcagaccctattccatacctactcaatcaaaacttccaggcatgggctccagagatctgtgtgttcaagccttcaggtgactctgatggcgtgcttacatttgagaccctctgctctggtctgatcacccagaatctcccttgggagagctaccttgaaatttctgcttatttcccctgcagcgtattgaagactccacggtggttgttttgttttgttttgagatggaatctcactctgtcacccaggctggagtgcaatggtgcgatttgggctcactgcaacctccgccgcccgagttcaagcgattctcctgcctcagcctcccggagtagctgggattacagacacgtgccaccatgcccggcaaactttttgtatttttagtacagacagggtttcacctccgcagtggtcattaaagcttgaccactaaattgccctggttcttcaacatgcactaggcaggctggaccagaagccaggagacctggctcccagtctcattatcattactaaccagtcctggagttttccctcaccatgaagatggaatttttaccatctgctttctctgctttgtgtggcaggaagataaaaaaataataataatggatattcaaacggtttatattgcatgtaaaatgcaatgtggcattgattgtagatcccttaattcagacagatttccccacgcagacgctgtgtgtcacagggggaatgggcagcgtcactttttacatccagtcatattgtatgaaattgcaacaaattcaaaaagatgccatcgtgggagtgtggtgagtaaaaaacagctttcatgaaactcaaatcttgaaagtcagatgctttctgggtcttgtttaactgtaaaagagatagatgaagtattagaaatggagaaggaaaggggggaaaagccatccatttactgcttaagaatggctctgctattgcgatacctaaggtcacatgcgtagccacttgggttaatgatactcagtttgtccacggagtggcagtagcaactgtctgagaatcagtctcagccggggttccttctgtctatagaaagtgaaagacagactgttattcaaattccatgtgcaaaaaagccttcttacattaaatacctgggcatttcaggaagaagttttatttgacttaaactgtgaaggcagtttctcatttgaggaaaagaaagatataacgtgtttcagttgaaatgtcaagatcctttgattgcacatttggtttcctaggataaattattctagccaatggagcagaaactggctaatcaaaggcacagtgcacagttacacttctgtatatcattctctttttttaaaataatagctggaattttttttgaaagtgaaattacaatttaccacctcaactcagaggacatattagcttgataacttattcacagttgctggtgagttcaggcttaaatcatcagctgtcactcacaagtgtttacccttgaactttccgaatgagacatcaaacgtcttggtagtgggtgggtttaaacaaagctgcccacgcgagaaccattgtggagcttcttgttccaggggccggtcacggacaagctcatgaccagcacactcagatgtgacaatcagataacaagaggcaagagaagactttctgggaaataaaagatcatttttgtgatttctttaaattcagatcatataaattaggtgaagatagacattatttctcctgtttatgtaaaagaatttagacaatgaagtcacgaaattcatgagaataatttaaagactgttggaacttcccaatgtttttcttggcattcagtcactacacatagaaatgtatactatgccggttcctaatgacttagcagttccctcaggctttgttccacaggatgtgacatctcctctgccaacttttcctgcctcctttcctaatcataggattgctattctccctgacaagtaaagaatgacaagatattttattaaaaagatgttttatttatcttttaaagattttttaatgtatgtatctgcctctgaaattattaagaatgccttaataataatccctctcattttatttcagaagacactattgtaatagcatggctaggaaggaaacacagctaattattaagatgaatcatttagcaaggtggggaaaaatcccttgtgtgtaaaaatatctagtgattgacatattaccaaatttacatgaaatagatttccatgtaattgagactgatttttcctattagatggaaagaaccttcctgatcaggactggtgttgggggaatgttttccttatgaaatcagaagcagagcttctgtagggccgtccaagatcaggatgcttacttcaagatgccactctgcatctctccccacctgccaagtgtttcctgtctcccagatgctttctattggcttattgtaaggactttgacttctgcgctacgtgaactggggagtcactggaagagtttcagaggtgcaccttggtagactcaggctttctctggatctcactggctgctcttatgagtccagaatggaagaggatgaggacaaatgcagggggatgttaggagaccactaagcaggtccctgtcatttctctctctgtgattccttttgctgccactttctccttgtccccttggctccagccccctgctgtccttgctgtttcttgcacccgcccgtgaggcatgctcctgcctcaggctctctgcctgccgtgctctcacctcgcagacccacgtgatttcctcccgaacccccttcaggcctcggtccaaacatcaccctctcatcgaggtcttccttgaccacactgcttaaaattgtccccctcgcctcaccttaccaccttcactgcctcatttctcctttgtgcttaatcaccatctcacacagttatccagagcacgagccccacgaggaagggtctgtcttgtccactgttggacccctgacacctaacccctggggctggcccacagttgggaattgcatggctgtctgaagccagcaccttcctggttctgctgttccctggaagtggggttcagtacaccccacgagccaaggccctcatctcagagggcgtgcacatggttgcctcaattgtgctttcacactggacccttcctgcagtttactctcctatgtcagatgcccttcaatgaaagcaagtacattgccaccttgtcacacctctagttaccattttctttatggtccaggtcctgaccagctctaaagatgggtcagctgctgtatttccaagaaccccatgacttccagggccccttgttcccaggaaggccccgcaccccagtcgtcccgtgcataacctcacgggccagcacctggtagctgctggaaggcttctgggggatgcctgggcccctccagccctacctctagtcctgccactttacaactgagcacctcccgctgctgcctgctgaacccttcagagtccttgccacaggccctatttactttttcctgagaaggtatgtgtgatgccaaagagagaaaagcagcatttgctaatttgggtaaaatgtttctttgggaagggcaaattgatgtacagttgtccctcagtatctgttgggactggttccaggaccccgtggataccgaaaccctcagatgctcaagtcccttatatcaaatggtgtagaatttacatgtaacctaaacacttcctcctgtacactttaaatcatctctagatcccttacactacctaatacaaactaaatgctatataaataattgttatactgtattttttaaattgctattattttttattgttgtgctattatttttattgggctccctcctccccctcccaccccagtaatttcaatccaaggttggtggaatccatggatgcagaaacaatggatactgagggccggctgactagacctatttttattgtaattactcattctcttctacctcattaagcttggttctttcaagcatgaatacctggttgaatctgcataacctcttattatcgacctacctttgttcacacacaaatgattgccacttagagctctcctaccgggctccttttgtaaaataaattttatcttctccagatagaaagaaatgtgataccttgcggattttgcggtttccttgttttgctggattgcaagtcctttagacataaacaaatgttctgtaccccgacatcggtggtacccagctctcagttgagaaagagatgtaatgtgaatgccactcttggccccaggcactcctcacttgcccccactggggactggttcataccctcctctcctggcctcagtttccatacctcttagtgaggcctttgcgttatacttcagaaatattgtcagtatgactttgaagatgaaagtttgcccccaaaatcactctctgttatcattgtgaaaccagagatggaatggaaaaatgggtttctgagacattttaaattattccttgcttgtctttagaggcaaaattcagataagaaagcttatcaattatacttttgtttctactcaaaaactcatgactgctcactcaaagactccttgttcttatcttaaaacattgtttacagtgtcccagatgaatggcaacaaatcctggggtttggtgtttggatggtacatttccctggggaaagaaataacagtttgagatggaaccgggttggggtgggagaatacttctcattctgaggaatatttaattttgccaagatgagcatttctagttcttagtctgttgacgaaaagagctatggtttgtttctggaacttttgataaaaaataaagaaatttgtagcctggggagtttggttttaaaatgcaaacacaggagttatgagttgagacttggacagggtgtcattttctttttaaagggcagcaatatgattctttgatttgtctttgttatcttgacttttaatccggattcctgggcagttgttcagccccaggacatctccatgggcaggtggcctggccttggcacactacccagtaaatctctgcctgagaggacgctttagctgggaggccaggctgatttttaaaggcagaattggactatttactctaaaacagtaatgcacactgtttagaaagaaacattcctattctgggaggaaggaggagacacacagaagtatcatttatttctagtcttttctggtagaagctatgaagctgagtttactctctggaaatttgtagtttattttctagaaaattgcattttatcactgcaaaaaggattttatttccaaatgagtaggcttttgagcaagagttttggagtcacagagatggggttaagaaagtgataatgtgcaatggcgattctcaagttcaaggagaaaaaataacatgcttttattgggatactttgcttgtctataaaagaaagtagctattggcatttatgtagaagtcagcagtttcttggcaccaaataaataattttgtgctgaataaagggagagttatccatagtatttattactaaccaaagaaatgcagggagaattgtaattcattaggttttgatggccaggaaagccaagctgtgttattagggtcatgacaatcacagacattacggatggctgacctgtagtatggatagagggcagagggtagagtgtgaaatatatcacagaattatgtcaaataatctggatagttactactgcttaaaatctaagtgcacagctagaaaagtgggtagtgacgcactacagtcttgctgaacactgggtaagaaaatcatagcaaacgttgagtctgttttggaaatgttctaaaaccagactattaacacagtgagccattttaaatgtggcttgctacgtgtttggagagaaacacatactcttttattaggaacatgaaacaaactctttgagccgcagtatcactgcgagtgagtttaattgctgggattaataaatcacagctgcaaacgttaaattcttggcaggattctttattcagctgttttccccttgccccattacattccagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccctctgaaaaagcatccaggtagttaacctgagttgagttagtcagttgaattaggagccttacccctcagagagtggtccgtggaccggcatcccctgggagcttgttagaaatacaaaatcttgggcggcaccccagacctactgaatcagaatgtgcattgcagcaggatccccaggtgatgctttcacatggcaagtatgagaagcccaggactagatccccagttctcaagtgtggttgtacataagaatcacgaggtaagtggtaaacactatggctgcccgggtcctggagagtccgttgtaattggtgtggaaggggtgtggactggcactgggattgttttaaggctccccagtgcagtctaatgtgcagaaaaatttgaagatgactgggcgtgatgacctctctgagtcattcgaagcttcactgaagtagtaagcatctgcaagaatgccgtttgctcccttcagactgtttgaggctcgtttccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgccccaaacagtccctgccttagagcagggtggtcgggatggcctggacagccacagcaattaaaaaattgcaacattttaaaattttagtctataatatatatacaaaggctatgtgtatggggtgggggggtgtttgggggcagggggtgtgtatgtgtgtataacatgatgttgaaagggaacttgaagacttggtccagcttcttttttttcaaccaagacaacttttgcaagggtgacacttttctttagtcccaacctgacatacggtttctccttgaacaccttcagtggctcagactcacaggtccgtttgttccaatggtgggaacttctgaacaggtcttcctttcaatgagcagcagtcagcctccccgtaactgccaccacgattctatcgtcagagctaaagggagcaggaccgtgtcccttatcacggcatgccatcttctccacctttgaggacagctgtcatgatccccctggcatctgtcccccaggctgtatcctcagtcccttccacagttccttaggagactcagtttccaaaccttctactgaagacttccatgttttctctgtgctcagaactgtatgcagctatcccgattctgtctaataagggcagggtagagaactctcacctgtcgcattctagatgttgtccccagaaaactgctggcagccacatgtctcattatgggtgtataaggcacttgctgtcaactaaaacaccttttcacatgagcagacacacatgctgccattgccatcctgtacttataaattataaaggtgattgatttaagctgagggcaagacttcacatttatgctgttaaatttcatcattccagcctgttgggctatttagggatctttactgacatcccaagtatcagttacctttacgtcattcacacatatgatacacacctcatttatgtctatgctgaagtcagtgtaaaaaaaccccaggctgtgccctcagacctcctgatgacactgatctcctagagggcaggcattctcttgatagagatgtttgcctgcatggcactgagtccagcacctgaaatgtcatctgcctcttgcttccctcccctatccaccggaccattctgagacatttggcaaatgacacactgaaacccagactgtggctgtagaattctcctgcattcacctttcaataatctgcccccagaggaaacacttaacacggttttgttgaaaccacgccagctgcacagcatcactccgtctctatttgttttccaggggccaggattaagctgttgatatgatcacttttagaatttacagatatctcagctcccatacgtggttatatgttttttgtttgtttgttttccagcagcacttttatttttccttacacgatgacatgttgctggggcctattgttctcacataacagtagaaaaccaaaatttgttgtcatctcttcaaagaatcgagaattgcatacagaaaaaccttacataaattaaaaggatgaatacatttacaggtgtaaatgcaaaccactttcaactcagacaagtaacagcccatggtgttctggcagaaaacatcagctaagaaaggaaactgggtcctaagtcttggactttccaacccttacagaccggcagaacagaaacaactggttcaggagcccttgccagcctccagagaaatcccagaacacgcagccctgacgtattaataccctgcacagatcagagactgctggccacgcagactcaccaagccacagacttgtcttccacaagcactttcttatcttagccacaaagtgaccaagccacatgtactaagggttgaaatcaaagatatgtacagggtattaagcaaatctggttatatgttttaaaacaacttctaagacaaattgatggcaagtttgtgtgaaagttttatatcaaagttgttataagaggttcctgagcaaaccaattgaaatacagtcatgcattgcttaatgacagggatatgttctgaaaggatgcatcattaggccattgtgtcattgtgcatgcatcatagcatgtacttacacaaacctacatggtacggcctactatgcgcctaggctatatggtatggcccattgttcctaggctataaacctttacagcatattactgtactgaacactgtaggcagttgtaacaagtggtaagcatttgtatatgtaaacatagaaaaggtacaataaaaattcagtattataatcttatgggaccaccatcacatatgtggtctgtcattgaccaaaatgtcatcatgcagtgcatgactatatttctgtctcagtaggggcattcataggggaaaaacggagtctagtttcaagatgattaggctgggcagtcacttgggattgtaaccttcattcctcagaaggaaggggttcttgatctcattgagatctaccagaaaattgctgaagccatttatcaagaatgcaacttacttcctagataggattactcatcacatcagacccaaaattttgcccagctcaggtttggttcctctcctcattcctggttgataataatctagtatgtatacataatttaaatgttattctccatgaaaaaccaaagttttgtttttaataaagaaaaatgtctatccaaatataattttcaaaaatctgaaaagatgactcatacaaatatagaatgaataaagcttttatttaattcattaattaaggaaccagtaagatggtaaagctggttcaaaggaaaattcaaggaatggaaatgtgtatatcagtcagtccagtgattgttgaaatgaatttcctaatagatgcaaaactgggtaatgtcctatagggcaaaacattgtaatctttgaggtgatcttttaaatagcaaagtcaaacggtggtacattctccagctaattaaagaataattgagtgagcctattaaacagtaccctagtataatttggaaaggctgcatctccatcttgccttatttttaggtttgagataatttttctttacatggtcattgctaagtgtgcaatgagatgatactgtactggaaggaacatacattggtatagtatttctggaaagcagtttggcagtgtgtgttaagaacttaaaagtttaatttttaggccaggtgctgtggctcatgcctgtaatcccagcattttgggggtccaaagcgggcggatcacttgaggtcaggagtttgagaccagcctgatggtgaaaccccatctccactaaaaatacaaaatttagccaggtgtggtggcgcatgtctgtaatcccagctactcaggaggctgaggcacgagaattacttgaacccaggaggcggagattgcagtgagccgagatcacaacactgcactccagcctgggcgacagaccaagactctctctcaaaaaacaaaacaaaacttaaaactctaatttttataccctttgatccagtaatttcacttgtaagactttattccaaagaaataatcaaaagatgcaatcaaagatttgtgtgaagtgtataattatgcaataagtgttttgagcacactatgcagatggtcaccacagttttctttttattacaaaaagttgggaacacttcaaattccaataatagaggataaattatggcgtcctcttaaatatgatgtggccccattacaaatggatttttgaaagttttttttttttccttttttttttgtggtggagtttcactttgtcacccaggctggagtgcaatggtgcgatctcagctcaccgcaacctctgcctcccgggttccagtgattctccagcctcagcctcctgagtagctgggattgcaggtgcccgctaccatgcctggctaatttttgtatttttagtagagacggggtttcatcatgttgggcaggctggtcttgaactcctgagctcaggtgatctgcccacctgggcctcctgaagtgctgggattacaggcgtgaactgccatgcttggccgtattttttaaagttcttaatgagggaagtcaagatgtaaaaccatatatttattattatctccattatatacacacatacatgtatacagagagaaaaagtaatgaaaataaccaaaatattaacaataagtatctgtgttatagaattatgattgttttttcccgttttccaaattttctacagtaaaacttttgaagcttttataaccaggaaaaaaatttaaaagtttgcaatgcattccagaaataagtgtctcaaactttgctaatttgaattgttcatgccttctctgcctgccttctccaccttcctccctggggctggtgttcccggcttgacattttaaaccctgtaagtggagagcagtggaagaatgatgccccagccctgagagctgagggcggccctgtttgtattttcttaggttgctgtagatgtcacagggagttccgggccatcacagccagggaacacaggatgttgccaggtgtgggaaaaggcctttagggtggtcagagtcccgaagggagcctcctaattcccagttggggaatggagatttcaagcgagttcttgtttccaggctgagatgagcacacttgcctcttacccactggcccagtggatcctaaccttggctacaaatgagaatcacccgggggacctttaaacaaacactgttgccactatcccacccacagtcaatcaaatcagactttgtaggggtggtcccggcatcagtggtttttcagaagttcctcaactgatttaaatgcacaatggaagttgacaaccaccagactgaagataccacgtgtgttaatgggcccaatgtattcaaggcccagtagttggccccatctcccctggtatcctaagaactctaaatcctttctagctattcgcttgtcaaactcctgagcttactttcaatggagcttacacattccctccttccctcacatgaccccaggcacagttaatggttgttcctagaggactttgtctttgttccttggggatcaggtggagtgagacagtatccccaagactaagatctctgaggagagtaaagacaccatctctgtgcctctggttcctgctacagagtaacttcctgatggttgccaaaagaatgaacagaagaatgaatgaatgcagcggttcttcctgccatctgataacagactattctttgatgttttcattttcaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcattttaaatttttgctattatatttttgtaaacatgttcaagtttttctgtaaaataaaatttttagaaatgaaatccctcaggccaggtgtggtggctcacacctgtaatcccagctacttgggaggctgaggcaggagaatcacttgaacctgggaggcaggagttgcggtgagaaagatcgcgccactgcattccagcctggacaacaggagcaaaactctgcctcaaaaaaaaaaaaaaaaataaaataaaataaagaaatggaatccctcaaaggatatgtacattttaaattatattaaagagtaccaaatttcccgcttaaaaaactttgatttcactttacagccccagtcatacagtatgagtgcctctttttccatcctttggtcaatgcaagatagaataatcttttgagcctgggcacagtgcttcacatctgtaatcccagcattctgggaggccaaggctggtggatagcttgagctcatgagttcaagaccagcctggccaacatggtgaaacctcgtctctacaataaatacaaaaattagctgggtgtggtggtgcatgcctgtagtcccagccactcagaaggctgagataggaggatggcttgagcctgggaggcggaagttgcagtgagccaagattgtgccactgcactccagcctgggcgacagagccagaccctgcctcaaaaaaaaaagaaaaagaagaatcttttgaatttttgccagtcttatgaaggtgagaaatgatagctatttcattgttgtaatttgcacttctctctcactaatgagattgagcatcttttgagatgtttgtgggtcacttttctttgtccttctgtgaatcacctgtttatatcctttgcacattttcagtagtggttgcttttttcttattgatttatgatagctgtttattatggataaatataagtacttttatatttaaaaattgtgagagccaagtacaatggtgcacacctgtagtcccagcttcttaggaggctgagacgagaggattgcttgaggccaggagtttgagtccagcctgggcaatgtaacaagaccctgtctctgaaaaaaaaaaaaaagaaaagaaagaaaaaaaaaagaagaggaagcaaaaggaaggattttaaaaactcatttatttaatttatttatttatttatttatttatttatttatttatttatttattttgagacggagtcttgctctgtcgcccaggctggagtgcagtggcgcgatctcggctcactgcaagctccgcctactgggttcacgccattctcctgcctcagcctcccgagtagctgggactacaggcatccaccaccacgcccggctaattttttgtatttttagttgagatggggtttcaccgtgttagccagggtggtctcaatctcctgacctcatgatccacccgcctcagcctcccacagtgctgggattacaggcaaaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccaccagcaacgtcagaaacgtagaccttaaagcggcttttaaaaatagaaaagaagcgttcctcacatctgccagtaatggaattttctgtcagtaaatggaatgtgtaggcaggacctggaataactggagagagtgcaacgcttcggggtgaagggcgggtggggactggaaatgttgagacgggggcagccatgggaaggtatgagtaatagaattctttctgtacgacacagctcatccagggattccagggaccttaataaatcacggtagctttgggcaagagttgggcacgttgcccgactgtgcaggatggattgatgctggtataatttgatctggagccctatagaggatctcgttgctttgcagcgatgcctggcaccccatagagataagttgcagggactgccgtgaagggcatgaagggtggcccactttagtcatgcatttattcaatcacccaacaggcacagagcaggagcttcccatgttaggaattccagatgcaaaattatcagactcaatatggtgaagacatttttaggccactgatttctgtgtaatttgtgtccaatatttcaaagccatttaaaaaaggattttgactgcatgcctagtagctgtttcagatcattttttaagtacagaatggataattagtcttcagtgatttgcctcttaaatgtggccatttagtttgaactcctttttagttattttaaacagtatatgcttaaacatcacacgattttataaagcaagaaaaatgaaatgatctccctattcccccacggtgtaggcctccagatccttttctggcttttaggcaggacaattaacaatgtggattctgcagtcagactgatggggtttccatgcatggcctcaccattaactcctcactggggagaccttgggcctcggttttttattcatagaatgcatgttgaataaaccatgtgggaaaaagcagagccagcaccagcccctgctgactcactgatccctcggaaaggtctgggatgagtcaagtcttcagggaataagcagcaaggacttggaattcctgagcaagccttgggttccccacgccctaggaagtccctctggaaggggagcaggacctctcccaccagatgacggagttcgctttctcgcccagcgcagctcccaccaggcgtgagctggcagtccagaagcggccccagatgtggctacccaccgcccagtctgcttccctgcctcaaaccccagggagacagaaattacctaaaaatgcatatcattgccttatgccaagatgattcaaataagcctgagaaagagaggccagcgctaaatacagacttggcagaactacttcacccagtaaacatctaatcagcacctgcaggatcctcattctgcccttctgggcagagcaccacgaactttccctgagttattttctaccaacaatttagaatgaattgctcgtgaagtagaaatgaggggaaaagcaactaatggtggtagaacaaagtaatttttacaattaaaagaagtagctgccagatgacagaacaaagtagaggacgggaaaataaatcattttcagggaaaaaatatatctatgactaatggttgtgattatgtttttgtcgattgtgatcctgaaactcaggaagcaaatggcaatcttgaccacaacatggagacaggaaatcaaatgcatttttggctaaaccagacttgggggaagtggcttggtttgcgtggtttctcatgtaggtgcagctgtgcttttctgtggtttttctcacacgggaagtgagaggcacagtgagctgtattcacactggatttaaaagccctgttcttagagaggaaaaaaccaggcctcctcacagactgccaagtcccagagcccaccatgtctgctctcaagacacaggcctgtccagagcccctgctgagggaaacccacccaggccacttttccccacaggtggccctgcttggtacctgtgcccccaccccccagccatggtatattgaaccaggaggaggcacccagcccaaggccagccaatcagagcactggctagtagcccaggaggtgtccctgcacagaagatctcctcagagaggaccgatggtgagtcggccgctcttgattctcaatgaaactcagaaccgctcaagtgaaatgaccactcaaagaacaatttctcaacaaagtggatttatataggacaaaataggcataaaagtatgaaatgttttgtgcacaaaggcctagatttgagacaagagctgatgtggcctgaagatctgtgagtgggactgcttgggaggccatgttccttctcaggccagagaaaggtcctggtctcctggcttcagtctttcattccctaacctccctttgaatgttagttacctattcccacataacaaagtgccccaaaacttaatggcataaaacaagcatggacattgttagttcacccagttctgtggggcaggaaagcgggtctctcatgaggctacagtcaagatgtcagccgaggtgacagtgaagatatcaaccaaggctgcagccggttgaaggcctcactggatttggagaatattattgattaaattgcgtcttccccaaaaaagatacgttgtagtcctaacccccaatagctcagaatgtggccttatttggaaatagggtctttgcagatgcaatgaagatataagttaaaatgagatcacactagagtaactgggcccttaatccaatatgacatgtccttatcagaagaggagaagacacacacacagggagaagatgaccatgtgacaacaggggcagagatcacagggatgcctctactagacaaggcacaccagaaattgcttgccaacaaacaccagaaattagaagaggcaagaaacaactccccacacacaacccacccctgcaggtttcagaagaagcatggctctgccaacaccttgattttggatttccagcttccacaactatgagacaataagtttctgttgtttgaagccacccagttcagggtactttgatatggcagacctaggaaacaaatacagaggatcacttgcaaaatggcccattcacacagctggcacgttggtgctggctgctagcaaaaggtctcagctcctcaccacttgggtctttccatagggatagctgagtgtcctcatgatgtggcccctggcttcccctgaagcaaatgatccaagagagcacaggtggagccatgatgtcttttattaactagtctcagaagtcacactgcatcatttggcaccatcttattgagttacacaggtcagccctgctccctatggaaagagacagagggtgttagatgcccagaggtgaacctcattgggtaccatcctgcaggtgggctgccactctgctcaatccaaatcacagctctcccgtttctcacctcccaacagttgctgttcctcaggccaaagttcacattctgcacagcctcagctccgcctgacctctgagctcacatgatggcccttactgtgaacctgggtttctggtccagccatagctacttctttaagctcctccagtgtgctgagcacagtctggcccctgtactgttgtctgcttgaaatggcgtcttctgatgaacactcatccatccttcaaggtctactctctcatcacagcttgtgactcttccactttttgaactggtgtttcccattcccagttcacagagccctttctcattgaactatttatctgagttccctctgccggaacatgagccatgcctagagtagccacctagtagtgagtgacagctctgtgctggatgcacataaatggtctcccttaactgccatgagccctaaagaaggtttgctacagctattttacagatggggaaaactgacagagagatattaatgaattgcccacatgcaaatatgtgctgagtcttggatttgcatctttatcgtgactccacggagacccaccctctaagaccagagccagtgtcctattcatcttttgtctctgcagcgttcagcatggcactgtcttggcttacaaaatctgctctatgcttgctgactgctgaatgaatgaatgaatgaataggtagtcacaaagaatgtttagaatgtttctcagacaggctgagaaaaaacacaacgaaacattatttccgtttggaaagtttttttatttttgtgttcagtactgaagtaaaacaaaaatctgaataacagctgcaccgttaaaaatgaaattaccaatatatgaactctaggcatcatgcatatataattttttgtagataacttttcttctcattttccttctcattctcttcatctttttctttttgtttgagcaaaaaaaaaaaagaatatattaactcgtaactggggagtctaagaataaattctcttcagccattgctgaatctaggggctcaaatggtgtctctggacacagtatcacactctactctgcactcttctttatcattttctcccacagacagactctcgtgtagttgcaacaatggccatgacttctaggcttcatctgcccctctcagcagctctagagaagaagctcctctttttacacagtccctaattaaagtctcagagatgaacaacctgggctcttgcttagggcacgtgcccatcctgaatcaatgatcggccagagagctgtgatattcttttgtttttttgagatggagtcttgctctgtcgcccgggcaggagtgcaatggcatgatctcggctcactgcaagctctgcctcccgagttcaagcgattctcctgcctcagccttccgagtagctgggactacaggcacgtgccaccacgcccagctaattttttgtatttttatagagacagggtttcaccatgttagccaggatggcctcgatctcctgacctcatgatctgcctgcctcagcctcccaaagtgctgggattacaggcgtgagccaccgtacccggccagggctgtgatattctgatcagccagcactgagtcacatggccactattagggtgagggatgataggcttagctctgacctgaaattcatggattgaggggtggggactgtttcccaggggaacactgggacagcgttaccaggggaaggggagtgggatatagttgggccaaaacagtaaatgtccacgaggcttttttcctctgagcagaaatttcactgtgatgccagtcaggtattgctgccgtaagggccatagcaggagggagactgcaaatcttgattgaggagatcttaagaacagagtgatttacacagctgtgggcaggatgtaggggaacccagaaaggataatgcactacccagcggccagcgacagcaggagctatgagcaccccaggcctgaaggtgtgaagggctgaaatggttaccagaagcaggagagggaagcttatggagagagcaggctggcgggagcaggggctgtgagagagacagccagaccgtagcggtgtgacaggcagagagccaggcgatccatatcctgtctcctctctcttctccgctcctgactcctgctgcggcctcccactggctggacccaacaggaaagcagaggataagagaatctggttggtgctatctagaagtcagtgttggggaggtcacagaacagaatggagaggggtagagtatgcagggaagataaatgcagccctggcatggttcttccagaacattctgcaagctcatggaccagttcatttgagaagaaatagaggagttaggggagagagaagcttcttaatgaaaataaccttggtagctagtctcaagattagcccccagtgctccccacctgctggtatccgttgtacaacacttcccacatttttctggggtcgttttgtgtaaccaataaaatatggcagatgcgatggcatgttacttctgaaattgggttataaaaggtactgcagaccgggcacggtggcttacgcctgtaatcccagcactttgggaggccaagcctggcggatcacaaggttaggagttcaagaccagtctggccaatatggtgaaaccctgtctctattgaaaatacaaaaattagccggcatggtggcacacgcctgtagtcccagctagtcgggaggctgaggcagaagaatcgcttgaacccgggaggcggaggttacaatgagctgagatagcaccactgcactccagtctgggcaacagagcgacactccgtctccaaaaaaaaaagatactgcagcttctatcttggttgctcacttgctatcttgggtccctccctctggggaaagccagttgccatctcccaaggatccctatggacagacccatttggcaaggaacagccaccagctagctgcatgagcgagccatgttggaagtgggtcctccagctgcagtcaagcttccagatgaccactgccctgggaaacgactgcaacctcatgagagaccctgagccggaaccaccccacaaagtcactcttgatttcctaagtctcagaaactataaaatataaatgtgtgttgttttaaaatcctaggttttgaggtaatttattatacagcaatagaaaactaatacaatagtcttgctaccagcaccttaatctcccacatccaagttaaaattcatccaacactcaatctcccagctatcctgactgctcctatacaggtatctctcccactatatatatatcaagtgctattagtggctattatttgttgggttacacaaagccagaaatcatctacatctactctcttttcttctggttttgaatagcaaaatgcaacagggagatgttctcagatagagggagaacaacaaaaagaagggtccatgctgaacaaacttgtttgctttgaaatcggaagttctagaggaggtattctgacagtggccaggaaaacctcctgcccgcagaattttgtctaatccaccccagacagagttatccaacagcctggtatggtgcagaccaggggctctcgaaaggtgggctccaggcagcagcaccagtagcacctgggaaattgttggaaatgcaaattcttgggctccaccccagatcaacttaatcggactctctgggagtagggcccatcaatctgtgtttaacaagtcctccaggtgattccgatcctaatcaagtgtgagcccactgtctaatgcggtgcataccaaagcaggtgcacgggtcttaatcatcacctcagtcctctgaaacaggcaagtgtgtccattttacagaagaaggaactaaggcctggaaggcaagtccttgcctgagactaaacagaatcccagcaacataggacgaggctggaattcccacacctggactaatgcacagccagtgtttcaacgtcgccaacccagaaatgttttctctccctgtcatgctaattttcagccctttctgggtgacttgttcatcatccaaatatattatttttgttttgtttgactaaaggcaattatatttacattttctctaagtactggaatgtaatggttgaaattcctattcagtgatctggaagaactctaatgttctaaagtgattctttgataattaaagaaagatgtaattatgtataatgtgatttgtaagataaggtataactttgggggtgttctaattctttaaaaattgttgatccgactatggatgtcttgcaactctcaaaaaatcacgtgtgaaagttaagcattagttccgtgtaaaatactgtgctagaaattgtggaggatgcaaagtcacataagactgttactgttttttaaaatttattttttaaaatagagacagggtttctccatattggccaggctgaatctcaagtgatctgcctgctttggcctcccaaagtgttgggattacaggcgtgagccactgcgcccggccaagactgttacctttagcgagagcttattatcacctagtgttcatataaacatgggatttaaatacacacacaacccccaaaacaaattgctaaaagatatttgtgcagattttatttttccaaatggctacaacagtatttgaagaactaacaagtttaaaaatgtaaaaggccagtaaggcaacattgggcactggggcaagtgaaggggagggaaggagcatggagtcaggggagagggcattggctggttctgcaggctctgcaggctgggggaagagttagggtttatgtgggcagacagcattgcaggggattaggcaggggaataacatggtcatttaaaatgattcttctggctgatgacaggttttcagatgcttcacctcctcctaagtcagtcacacctcatatccaagccatgaggactcactgaggggaatgtaataaatagctatttaagggaaaaataacaattaaaaaatctataatagcagtttaagggacaaaaaccaaaacatttctttggaattattcatgttaagcttaacattttctaatatagtcctgcatccttttttttgtttttgagatgaagtctcactctgtggcaatcttggctcactgcaccctctgcctcccgggttcaagcgattctccttcctcagcctcctgaataactgggattacaggcatctgccaccacacttggctaattttttttttttttagatggaattttgcacttgttgcccaagctggagtacaatggcatgatcttggctcactgcaacctctgcgtcccgggttcaagcaattctcctgcctcagcctcccatgtagctgggattacaggcatgcgccaccatacccggctaattttgtattttagtagagacggggtttcttcatgttggtcaggctggtctcaaactactgacctcagatgatctgcccgccttggcctcccaaagtgctgggattataggcatgagccaccgcgcccggcctgcatcagtttttaaaagacatcagacacgtcaaagccacaggaggaaaagcccctacattcatgcacaacagaaaggctttgttttcagtaaacacgcacatcttcaaagaatggttgcaatccaaattgtttagtaactattagaggaacaaagaaggctgtgtcctctgaattataatgtgcatatcctctaaattgctgcatattaggggttgaagcatgctgggagtttgacgtatgtaaggaaaattattaggttgatggaatataaagatacttataataaaagccagtattttggcatttataaatgaatctgaaaagggtgaagaacttcattgttttgcaattaataccacaaaatgtggcccttgtgttctactggcccctgaaaattgtttcagatctttccttggtgcagtgtatattgaatagtaaaagggacatatgtcacaaaacagatttattcctacaaatttacataaaaaataagaagtgaaaaaataaacccagattttgaatgcgctggcttgggagcccagagaccaggcctggcttgcttttaaattgttgtgtgacctcagccatgtacctgtgcctctcaaggcctaaggtcctctctctgtaaaagaggggactacatgagatgatttcagctcaaatatccttggagactctcattgttttctagttgtaaattatgctttttctaatagtaaataagaaacgaaacagtattcatgtatgacagagaatactttgttgtttttactttgttttgtttttgagacagagtctcactctgttgcccaggctggagtgcagtggcatgatctcggctcactgcaacctctgcgtcccgggttcaagcaattctcctgcctcagcctcccatgtagctgggattacaggctcctgccaccatgtctggctaatttttgtatttttagtagagacaaggtttcaccatgttggccaggctggtctcaaactcctgacctcaagtgatccacccacctcggcctcccaaagtgctgggattacaggcatgagccactgcacccagcctactttgttattattatagatgtaagatacaatgaatttctctgagtttctctttaaagatttagcctgctaacttccttgacctttgttttcaaacctcaacttttctgttcctccttgcccctagttattgtaaaatagcctacccccttcccatcagttctaatcaatacctcacatctgttgccttggttacctgcacccattgttcccctcaaactgcatgtctcacacacttcaccactgtacctcacgtccccttcccctccatatttagaaaaatatttccaagtagccagtcaggtcagctcagattgcgcagtctgaccccagctcatgcgggagggacacagaggtagggattgcattaaggatataaaaactgcctggtctcctttgttctttgtgctcttgcaatcttgattgactcaagtggcacccttctgcagaagtaaattgccttgctgagaaaacttttgcctgggtgctggttttactttgcggcactgagcacttattcctagagcatttttatatccaacatagaatattttataaaacaaaaacaaagactcaatttgtaatatgaatcctctccctccgggctggaggctagccaccccctcccaactcattcatttgtttaatatgtttagattttcttaatcagtgttgtgattatctattgctaagtgcataagtgtcacttcatttcattaagttccactaacttaagtttcactaagttccacttagtttctaagtttcaactatgaaacgtaatggcttgaacagccattttattttgctcatgaatttgggaaggactcagttatgcagcccacctctttctggccggagtggtgggggatggagaacccacttccagggtagtttctccactcaggtccctggcacattgacagggcagctggaaggctcctctgggcctctccatgtggtctttcagcatgctggtctgaggatagtcagacttctaacaagacatctcaggtttcccagacagggtattataagagacaggaagaggaagctgccaatttcttaaagctgtggccagaaacaggcacagtggcacttctgccatattctatcagtaaagttgctacagcacccttctagattcaaggagaggaaatacagagcccactcatcagtgggaggagtgtaaaagaatttgtggctatttaaagtctacctcaaagtaggctgctgtactgatgtcagtttttatttattgagtgcttagcaggcatagtagctccttgaatctttccaataactctgtaagatagatatctttattaatcccattttacagatgaagaaactgagacacagagaggctgaacaactggctcaatgccccccagagctgtatgtgagctaggttttgaacataagcagtttgtacatgggaaattaatgagctaattaggctatttattatcataacttcatgtaattattacagcaatggtaaggcacattacaagcactatgcaagtaagtagcctttccatattccaggtaagcacccttcttgggtggggatggtcccagctgcttttttgctgtgggctcagaagattgtgcctatgggtgagtgatggactgttcgagggcaccttccacaggaatctttgtcagtttctctaggcatgaatcttgcaaacaatataaaagtcttcaagcaacactgaaaaaaaaaaaagagtaccagaaacccaagatataacaggttgacaaaacagttggagggggccgggcgtggtggctcacccctgtaatcccagcactttgggaggccgaggtgggcggatcacttgaggtcaggagttggagaccagcctggccaacgtggtgaaaacccatctctactaaaaatacgaaagttagctgggcatggtggtgcacacctataatcccagctcctcgggaggctgatgcaggagaatcgcttgaaccggggaggtggaggttgcattgagccaagattgcgccactgcactccagcctgaggtgacagagtgagactccatctaaaaaaaaaaaaaaagaaagaaagaaaaaggaaatggagggaatttcagagttcagagagagaatacaagttacactggtgctcctgtccacagtgtcctatggacaagttacagatggcacagctaacaaagccctgttctgcgtggaacatgtgtttcagccccctgatggctattacctggttagtgagagaatatctctttccagcacctgttaattgagtgacgccatgctgccccacagggacaatggaacgtttgggtgccatggaaattagtaccaaggcaatcttgccaggcactcgggtatagcctttgtacatgtagcccacttttatcttgcccaaacttcagaccgatttttttttttaaaccggatattcagagtgagtcaaacccctttaatccaagatcccctaacaacacagagtggaagctaccctgcccaatagcaaggctgcttgacactttgaggaactgagctcagtcctcccaggcaaggcacaccttcaatgctaccttatccctttagttttccctgactcttctgggaaaacgaactgctctccaatctgtattcaatgcattcctctagaatagcttattgagtacttactatgtcactctctttctgcagaatacttttgggaatcaactcatctcatttataccagaaccctggagtcttcccattcacatttgacagagtcgatgaaaactcaggaaggttatgtaacttgccaaaaatcatacaggttgtcctgtctgcctcaaaagtccacaaatttgaccacacagccctgctgcctcccactgatcacagggggctgtatgtatctgtccccatgtccagttccccatcaggttgtaaactccattaggcctggggctggtgctgagcaaggctcccaggacctagtacattctcagtaaatgcttgaatcaagtttataaaggttgagggcatctccagggctctatgggcccaagaatcctaactcaaaattagtatatctcacacacctactctaggaagcataatgacctagggttcctggtgcagtttgaaatccattgctgtgcttataatgaaggtcgtgcttccacacatggcttctcatccatgactgagtgtgggggggataataaggcagatccatgcctgggaaggggggcactctaggtcagtggctcacttcagttcaaagactcccaagtgctttgccaaatgttcattagacacacatggcaggtaggatgttcccactcaacctttgatcttaatctccttcactggggttagacttgcattgtggtttgacagctttccagccacccctggctccatcatctctatttcctttcacataggcgctttctctagtaaaattcttgcatgtttaaaactgtcttgacatctgctttttggaggacccagactaacagagttaatatttcaattttttattcgtttccttatcattaacgacttctattcactctaagatgaccatgtagattagggaactgaatgtcagagcagcaaatccctcttttctaagatgcctttcaggagtgtgtcccacatactaggcagtgtgccaagtcctttatatgcagtcttcccttcaatctccaacagtgctgtgagatcagtaggatgactttccttttatcctatgataggtcatcctactaatgactgtcctatcatttcatagataggacatctgaggttcagggaggtttaattatttgcccaaaggtcacacagccaaaaagtgacagcgttcagattctagactgtttattatttcatttaattcttctcataaacccaatggaaaatataagcaagaataagaaaagctaacactcactggacgcttaggtgtcaggcacttcccatgtattttttcatttaattcctaccacaaccccatgagggaggtactatggtcctcatttcacagacaagaaaactgtggtggggagaagttaggagatttgcccagggtcacccagctaggaagtggcagagccagaattcctgctgggaccaactggctccaagagcccatgtgctccctccttcttgcctcccactcgtggcaatactgtcccagccatacggaaaggtgctttaccttagctgctattcatgtggttttctctgcatccgttgctacccatgaagggaattacaactcaggaaaactgaccttttccacttctgattcgactccagacacaggtctagtcttgtttcagaaccctctgcttttcatttcatttgaatccatgttaaaacacaatagcctacatatccaatgtcttacaattgaacactaagaagccaccaaggatcacatttattgtgtttatatacaatgtgttgacacagaaatttacagcaaataaaaaatttacaaaccggacatatgactccatttaaaaatgactcatattcatagttatagatttggaaaatataaaaccaatttatgtgtttatgatctcttagtggcaagtttacaggtggttttgtttaaagtatcatacagagtaactttgctcttctaaaaatcctctgttctctgcctattcctttcctccctcatatcccctggcaaccgctgatctttttactgcccccatagttttgccttttccagcatgccatattaaattcccaggagtaggattgctggatcatatggtttaagtatgtttagttttgtaagaaactaccaaaatgtcttccgaagtggctgagccattttgcgttcccaccagtaatgaatgagttcctccaagctgggcatggtgggtcatgcctgtaatcccagcactttgggaggccaaggaggatagatcacttgaggtcaggagttcaagacaagcctggccaacatggtgaaaccccgtctctactaaaaatacaaaaattagccgggcgtggtggtgcatgcctgtaatcccagctactcgggaggctgaggcaggagaatcacttgaacccgggaggtggagactgcagtgggttgagatcatgccactgcactccaggctgggcaacagagctagactctgtctcaaaaaaaaaaaaaaaaaaaaaaaaaaaagaaaaagaaaaagagctcctccacatccacactagcatttggtgttgtcagtgttctgaatttccaccattctaattggtgtgttgtggcatctcattttgtttccctgatgagatgtgtggaacattttttcatatgcttatttgccacctgtatcttctttggtgagatgcctgttaaggtttttggtccaattttaaaagttgcttgtgttcttatttgtgagttttaagggttctttgtatattttggataatagttctttatccgtcttttgcaatttttttcctcccagtctatggcttgccttttcattctgtgacagtgtctcacagagcagaaatttaaaaattgtaatgaagtctagcttatcatttttcatgggtggtgcctttggtgttatatctaaaaagtcattgtgaaacccaaggtcaggtagattttctcctaagagttttatagttttgcattttacatttagttctgtgatccattttgttaattattgggaaggatgtaagatctgtgtctagattcactttttgcatgtagttgtcttaattattccagcaccatttgttgaaaatactgtcttcactctgtcacattgcctttgctcctttgtcaaagatcagttaactatatttatgtgggtctatttctgggttctctatctgttccactgatctgtccattctttgaccaataccacactgtcttgattactgtagttttatagtatgggtagtgtaagttgggtagtgtaagtcctctcattttattcgtctccttcaatattgtgttggctattcttggcttttgcctctccatataaactttaaaatcagtttgttgatacccacagaataacttgctgggattttaattgagattgcactgaatctataaagttggcaagaactgacatcttaaaaatagtctttttattcatgaacggactatctctgcatttattttttctttgatttctaccaatagagttttggagttttcttcatatagatcttatacatttttacaagttttatacctaagtactttgtatgttgggtacaaatgtaaatagtattgtgttttaaatgtcaaattcactgttcactgctggcatatgagaaagtaattgatttttgtatatgaaccttgtatcttgcaatactggtataattacttattagttccaacttttaaaattcattctgattttctacataaatgatcatgtcatttgtgaaaatgttttacttcttcctttctaacctgcatactttttatttccttttcttgtcttatattgcattagctaaaactttcagtatgatgttgaaaagcagtggtgaagggggccatccatgtcttgttcctgatcttagagtgcagtggcatgatcatggctcactgcagccatgaccacctgtgctcaagcaatcctcccacctcacccgcctgagcagctggaactataggtgtgtgccaccatgcctggctaatttttgtattttttgtagatacagggtttcatcatcttgcccaggctggaggttttttttttttttttttaatagatgttctttatctagttgaggaagttcccattttcctagtttactgagaatttttatcatgattgtgttgtatctagctagtatcttgatttgctgagaattactgcatctatgttcatgagaaatatttttttttttgagacggagtttcgctcttgtcatccaggctggagtgcaatggcgtgatcttggcttactgaaacctccacctcccggtttcaagtgattctcatgcctcagcctcccaagtagctgggattataggcatgcgccgccatgcccggctaatttttattattattagaaacggtttctccatgttggtcaggctggtctcgaactcctcacctcaggtgatccgcccgcctcggcttcccaaagtgctgggattacaggcgtgagccgccgcgcctggcctacagtcttcttataatctttggttttgaaattgaggtaatgctggcctccttgaccaagttaggatatattttttctgcttctatctctggaaaacactgtatagaattggtataatttcaccctgcgtgttcagtagaattcagcagtgaatccatctgggtctggtgctttctgttttggaaggttattattgattccatttctctaatagatataggtccattcagatataggcctatttcttcttgtgtacattttggcaaattgtcttttaagatccatccaggttatcaaatttgttggcatgaagttgttcatgatattcctttattatcctttaaacatctatgggctctgctctgtattgaagtctcttctcatttctgatattagttgtgtccttttttttccccctttagcttggctagagttttactgatgttattaatctttaaaaaaacccaagtcttgattttgttgtttctctactgaaatattttttcaatttcattgatttctactcttaattcttgtcttctgcttactttggatttattttgcttttctttctctagtttcctaaggtgaacacatacatgactgattttagaacatttcttttgagacagagtttcactcttgttgcccaggctggagtgcaatggcgcgatctcagctcacggcaacctccacctcccaggttcaagcaattctcctgcttcagcctcccaagtagctggaattacaggtgcctgccaccatgcctggctaatttttgtatttttagtagaaacggggttttgccatgttggccaggctggtctcgatgttcactagatccagctggttgatggtgttaagcacaactatgtccttactgattttctgcctgctggttctgtccattagtgatagaggggtgttgaagtctccaactatgatagtggattcatctatttctcattgcagttctaccggtttttgcctcacatactttgatactctgttgttaagtgcattggtcaaataatggagaatgaggttttgaaagagctctagctttgttttgttccttctggtggctgctaggctgcaacaggaatgtgggctgttagttttcagggcttctacagctgaacagtgaaaaaggcaactaatccaagttaaaacatgaccaaggctgttggtcttaggtagattcagtagtttttcttgaactaaatgctcctgagattgctgacagcctttaattttcagacttctaaacagtcgattctgagaaattttgccagttttatcacggctcttatgaagcagctagttttcggaggtcattcctcttgccattttcactgacatcatttagcaaaagctttttgaccatttgggctttaaagatgaaaatttatgttggcttccatgaagggatttaaaaaaaagatgaaaatttaatttttcttaaagaagggtaaagagaaagaaatataagattaaattactatttttttcaatgaaaacacatggacacaaagaggggaacagacactagggcccacttgagggtgaaaggtggcaagaggaagactgttcaaaaaactacctattaagtacgacgcctattacctgggtgatgaaataatctgtacactaaccccccacggcatgcagtttacctatataacaaacctgcacatgttcccttgatcataaaatgttttaaaaaattagtttcaaattaaggaaatatttcttttctaattaagctagtagacaggtatttcaattctaattaagatagtagacaagtaagagtcataggggaaaggggaatgagacaaccacaaggaaatgagaagtaacacaaaaagaggaatgaagcagagaaatggagacattttttaagtgctggagagggagagatggagaactgatctagaagggagagcactagatatcagcattttttgtcttaaaagtagtcactagccaagctttcctatcttctttcagattaggttgtgctttgaaagggatgaacacagttaacacaccagagaggggactggtgctacattcttctggagactgaagtagggaagaggttggttttctacctttgaaaaagggcagatccaccaaccaaccaatcagtagcactgccaagcaagaactttccaactcaaaatacatgtttgttgcccagttttatatctggactacccacactgtaagggtaccacaaaaagagaaggaacaggaacaaaggaaaggctaccaagcattcccatggaaaagttgaaacagcaacaaatcggttggcatcactttggcctaactgtggaaatggaacccaaactatactccccaaaatggcagagaatactgccccatcccacggaggtagggcgtggccacgatttgttatggccagtggagtgttggcagatgtgatgcacgcagaaggcacaaaccatacttgtgtggttgggcttgccttcttgtgcttctaccatcagtgtggaaacttctgtataacttttctattttagcccaggcccaagaatgaacatagatgggagcaactggaagcacaactcacagcaggtagtaaagcccagccagagacccagcttgaagcagttacccacacaagctgatgtcagccaatctgcagaggcatgagtaagagtgattaaacaacttagatttggggtggttaggtggcaacagcaactgaaatgtaagaagacatcattcttttaggatccactcctgagggcaaactatgttacctccccctttactgctgtatgccaagagcctagcacagttcctggcacatagcaggtgttcaataaacacctgttgcagtcagatttacatgtttctcctaaaaataatctaggagaataaaatgaggggaacttacataatttagtattcagtgtgtgtctcaacttcaaaatcaacaatttcaacaaagaccagattgcacgtcagcagtcattagggggttaagagcaccgacaatggacatgactgcctggatttgaatctaggcttcacaaattaccagccaggtgaccttgggcaaacactacttcatctccccctttcctcatctgttaaatggtgctataaatagtacctaccacgtagaacagttgtgtgggttaagagataatttatttcaagtacttacaaccttgcctggtacatgataaatgctgcataggcattttctattattattacctgcataaagaccactttgagaaaggttattaaagccctcttcacctgttcctcccatcgcctatttatatctacttgttctcacttctattatctaatcttgtacgtgtttccaattagctctcttgtatattttcatcatctttccatgctcaggattgctaagtgccaatatatctactctatcccagagcgcccctccaccaactccaccaaccatttaaagagctgctgattttgttcttttcacatagggtttgcacccttctccatctgttcaaatctgattctcaatgtccgcacctagtcttccatgacgcctgttctgatcttccctcccaatgtgatcttattctgtaccttttatcaattaatctctacctcaattacacttttattactttctacttatacctttccacaatgaaattaattgtaagctcctaaaggacaagatcacaatttcttggttttctgcccattcccactcccaagtatacagcaggcaagcagtatttgttgaataaatatatttgaaaatcccatatagataggttcatttaagtctaaaacaactttgctaaaaagtcatttttttattagaaaaggaaaaaaaacttgtcaattcaatgctagacagtttaagggaaaagaagtttgcatgtaaaagagacagacacttgatttattgcattaaaaaactttatttcttttaaaaggtccaatataagccaaattaaccccaaaatttacagctacacttagagatctcctgaactaaatggcattgtttgagatgagtgtcttgttaaaggaggtcatttgctattaccaccatttcacccaaagtagttctagagcagaagctggtattataatacacatcagatatttcagatgtcatcttttatgtataagttaaataaagcaaacaggcttttctactctgtgtgaggataagaaacactacagaacagggcctgaatgctttagacatacaaggtgtaaccataaaggaaatttctacggtgctgtgttcattcattcaagtaattaatgtacttattccaacaatactggcgtagttcaaataccatttgagacagtactttggggtttcccttcattgggtgcagaccaaaggaagtggttaagctggggggcagactctcacagatggattacaaaagtaatgaaatagttttcttagtggggtggcattcgcaagaactaccttaatgtttttggtaacagcatcatttacatataagtgatgcaggatagaagttctggtgtatgtgataaattaaaaacagcttgtcactttatagctacaccttggatttcattagatgtggtaaatctaatagtgtgtcaaatgagtccttctggaaatcacttcagcagagaagtcaaacagcctgtaaaagagaagacatggcagaatgtgcgagattcatccttccaacattctcagggttctcttggaggacagacccaggcccaaagacagaagttaccgggagggaggcttcaactccatctaaggaagacctttctaacagttagagctgctcaacaactgaatggactgcttggtgaggtagagtcacttggaagtgttcaaggtggaaagatcacccttgtagaagggactcctgcatttgttaagaggttagagactggatgaacctcaggtctctttcaattctgagattctagaaaattccctcagggaattcagaagagaattcctaaaaggaaagagaaagcacacatatgtatacttttagaatctgcttgatttttttttttttcaaaaggtacaatagaaaatgtagtccactgtcattaaaatgcatattcaccttcctactactaataattaggaagggttcattatgacttctttatattataaagaaaagatgggggattagatttataatttctgtaaatattttagaaaaaatgcttaaaatctagtagtcaatgccctagaaactttatagatttgtagataatatgcacagatacaaatacattattcattaaatacaactcacatctgtgttttattatactctaaaatatacaggaatcttgatgtactgaaagagtgcaagtaaatacagtattcaagcagtcactatttctatgtacatgctcattaattcttcaaaaaacccacaaaattatcaaatagatcaaaatactgttctgtgttttcacactttatattcagaaaaaccagctgataatttacaatgtcataaagtttccagtttcacaatacaaaaaggataaaatgaaattgggtatcattttgttgcaatttatagaactttacccatacctgtaagaccctcaatgtatatgaaatcattttcactgggaaagtgacagttacagtaaaagcagaaccacacaaatctttatttaaaagccgaaatatcagccttctctctctcttttgctatttgaaaggtagtcttcaatttggcaggcaactgcttctctctccaaatagtaacaggttacaaacatgctactttaaatatgaataggacctaaggctttagtattttaaatcttgcccaatacagaaatgcctttcaagagactttagtgatgcttaatttatgaacaacaaggaattattttccttttgattattcactttttcaaaactcatagatcagaataaacaaaaaatcccccaacccatggtggggacacaaaagtaacataagtgactaaggtgtgccattcatagagaggttgaagactccatgccccaggaccacttagctgcaatagggtgaaatagtctactttttgatttcatgaatttttttctaggaaattctttacattttcaaacaaaaatagtactattttaaacccaaaccattcaaaacagggcaacagcctgaccccaatccatctcaatgtctatgtcacaagtattttcacccgtattgcacccagtcagctggtttttaattctaatagtataaaaattggaaatttgaaatagttctgtaaaagaaaaaaatgtaaaaatacatctgctttctctcatggtttaatacagcattggaaggctttcagatgttttcttaaaaaaaaaacaaaacccaaaaaaactcaacatttaaaaccaaatctcagcttcatttccagaaatattgcagtttggtttaggtaatgtttcatttaatctactccagtttccacaaaatggcattttattaaaaaaacctttcagttatttggtccttttgcaatttgctgtgcacataatgcctactgtaccaaacttttattgcctttaaatttagttgtaattttattgataaaatttaaatctagtgtctttatttcttctgttacaatagtgttgcttgtgtaagcaggttagagtgcacagtgtccccaattgttcctggcactgcaaaaccaaattaaacaattccacaaagaattctgacatcaatgtgttttcctcagtcaggtctatttcaagattctagaagttccttttgtaaaacttgcctttaaaactcttcctcctaatgccatcagatctcttaacattggctcactgtgggatctttcctcttaggttgaatttctacgtgaatatcaaagtgcctttttcctgaaaaagcacagtttgaagctttactgtgagaactccctcctcctcagcctctcagtaggtctcagaatcggagtcgttgagctcatccacgtcagtgtataagtactcctgttcccctccaatgttattgaaactgcaataggagctaggttcattcctcatgatgggcaaagcttcaaagctgactgtttttgaggtgttggtataacggttaatggcattgaatgttaaggatgataaaggactacttgatgagacaggcatcatggtggccaaaatgagagccaggcaatcagccacatccttattgggagcacaggccaaagctggggtatagcctagaattaaagataaaatttaaaaattaagcatcctgagatgtatttcaccaaagacaaggaaataagcctaaagtacttcaactttagacatattttacattacttagcttataataaattgctgtaaccagcatgattcgcaagtttctaataagtagaaaaagaatagccatagaaacctagggtggaaggggatgttagactagacaacagaagaggaagcaggcccagagaagaatgattccccaaggtctcacaacttatccgtatccatctgaattcacagaaaaaactgggctagaataagaaaaacaccacatatcgtgaatattctttcaggatggtaggcagagatttactgttaatttgcagttatatcagtgtcaaggtaagaaaaaataaaaaaatttaatttgtagttatgtaaggaaactttttgatgctaagaaatcttaaatgtgtacagcttcatgaatcagccacagggcaggtgctcaaaagatatgtgttgaatgaatgacacttagttgtcaatttaacttttctcttggggtcacagtctcttgaagaaaaacagtagacaaactaagcagatgaactttaaaaactactaaatcaaaacaaatatttcctttgtaaatattccctttttttaagcggaagacaactgaccttagtcgtaagttaccacaaagtgtcaacacagcaaaccaaggaggaaacatttggtacctcagttggtacaagactcagtcttgaggacggagcgggagagaagtgataatagtgtgatgccaagcttcaattataccatatggaactttaatagttttatcacataacatacatttgtataaccaccatacagattaagaaagagaacattaccagcataccagaagcctccatatatcctctacccagtcgttacacctttcttcttccacaatggtaactactatcctgacttatggggtagtaatttccttgctttcaacttggagtcataaacactatagttttttttttgtttttttttttttgagacagagtctgctcggtcacccaagctgaagttcagtggtgcaaacttggctcactgcaacctttgcctcctgggttcaagtgattcacctgcctcagcctcctgagtagctgggattacacgtgtgtgccaccatgaccagctaattttttatatttttagtagagatgggatttcgctatgttggccaggctggtctcaaactcctggcctcaagtgatctgcctgcctcggcctcccaaatgctgggattacagatgtgaaccaccttacccagcctacagtttagagtttttaaaaaacttaatataaatggaatcatgtagtatgtattatttcatatctggcatttttgtgtagcattatatgaaatttatcaatgttgtatgtaactgtagttggttcattttcattgttatacagtatttcattgtgtgattatactatggtttagttatacatttcaactactgggcatctggttgcttccagttctcccacatattttcatctatgctatattggccttgataaaaaaaggatttttttttttttttttgagacagggtcttgttctgtcacccaggctggagtgcagtataatgatcatgctcactgcaccctcaacctctgggctcaagtgatcctcccacctcagccccctgactagctctgactataggcacatgccatgcctggctaatttttaaacttttttgtagatacagggtctcgctttgttccccaggctggtctcaaactgctggctttaagtgatcttcccgcctctgcctcccaaagtgctgggattataggagtaagccactgtgcccagccacaaaaagtaatttttccccctttgtaaagttcccattttgtcaagggtcaaagagaacaactgatgtccttccaagtttggcagcagtggctgaaggctgtccgtatttttaattaaattttatttgttcaaagtagctgggggagtgcttcactgcccacacttctttcaagggttcttctaaaggtgcctgctgctgttcctgctgctggcaggcagaacaacccattacataggccaggatgccttggatgagagcgggagtggggaaagaagcttgtttcaggtgtgttttctagtcagaatatgactaaaaacaggctcctctcctctgcatgggggttattttttgagacgaagtctggctctgtcacccaggctagagtgcactggcatgatctcggctcactgcaacttctgcctcctgggttcaagcgattctcttgcctcagcctcccaagtagctaggattacaggcacatgccaccacacctggctaatttttgtatttttagtagagacggggttttgccatgttggcggggctggtctcgaactcctgacctcaggtgatccactcgccttgtgcctcccaaagtgctaggaccataggcatgggccaccatgcccggccagttttatctcttaacatgccactctctttgcttagaaagttcctcccccactttctccttatcctttggattttggcttagcagttgcattttttgggatgccttctctgatcctgcaagaaaggatttgaagaccctcttaagtactctcatagcattctatgcttattccaattaaactattttaagtgcatcgttaataggctgtttgcactcttatctccattcaagggagtagactatgtcttattttacactatatcatcagaagttagtacagtgcttggcataatcactcatgcagcaaatattcactgagcctccacttgctcaggcactatttagaacactaagaatatatcagtgaatgcaactgacaaagatttcactgttcttgtggagcttacattcactttagtggagaagacacaaaatcaacataacaaaaaagtacattatatacaatatgttaaaagctttatgtaaaaaaagaggaaagagtggagcaggttaacaaggactgagaatgctatggtaggggtatctagcaagttgtagtaaagaatagttagaatatgcttcattgagaagatgaaactggagctaagatttgaaacaggtgacgaatttagtcatgggatgtttggggacagagtgttcaggcagagtaaacagccagaatgaagatcacaatgcatgtataaccctgctatggaggggctggcatggcagaatgaagtagagaaaggagaagagtaggaaataatatcagaaaggtaacaaggtggaggacacatcatgtagggcctagtaaggtcattttaagaactatgagtggggccaggtggagcactctgggaggctgaggtggggggattgcttgaggccaggagttcaagaccggcctggacaatatagtgagagtctgtcagcacaaaaaataaattagctaggcctggtgatgcatacttatagtgctagctacttgggaggctgaggtgagaggttctcttgagcccaggagttcaaggttacaatcagctatgatctcaccactgtactctagtctgggcaacagagtgagaccctgcctcttcaaaaaaaaaaaaaaaaaaaaaaaagaagaagaaccgaaattcaagagtaacatgttctcatatactttaaaaggatccaggtcagtctggtagcagtaaagaaaaaagtgggcatactttagatctactttagaggtggagtcaatagtatatgctgatggactatacattgagtatgagtgagaggaatcaaggatgactctaggggttttgccctgagccactgttaagaatgagaattgtcttcaatggagagagcatgatgctgtggggagagtaggtctggcaaggggagtgggaaaggatcaacagttcagttctgcacattctaggtttaagctgtttatcagacatccacatggatgtgtcaattaggcacgtggatatatagagactgtgagaagtctgggctggagatataaatctgggaatcctcagcattataggtagtatttaaaaccaaaggaactgatgagagcactagggagtcaatgtagatagagaaagcaaaaagaacgaagaattgagtcctagaagaagagggagaaattttgtaaaagaaattaagaaggaataactagtaatgtagaaggaaaaccaaggaagagtggggttcaaaaagcagagtaaaaaaatttatcaaaggaaacgatcagttgtgccaaaagctgatctatcaagtaaaatgagagctaagtagtagttaacacagtagaagtcattggtggttttgatgggaacagttttgctatgtgtaggggtgagggggagaaggcctgactatacggaaattaagagagaatggaagaatgaggctggacgctgtggctcacacctgtaatcccagcaatttgggaggccaaggcaggcagatcacctgaggtcaggggtttgagaccagcctggccaatatggtgaaactccgtctctactaaaaatacaaaatttagccaggcgtcgtggcaggtgtcagtaatcccagctacctgggcaggctgaggcatgagaatcgcttgaacccaggaggcggaggttgcagtaagccgagatcatggcactgcactccagcctgggcaacagagctagactccgtctcaaaaacaaacaacaacaacaacaacaaaagaatggaagaatgagaggaataactgcggacagcaagagagtagttttgctgcaaaaggggacagagaaatatggcagtagctggcaggagcagtgagatttataaattattttttaaggatgagggaactaatgtttatatactgagaggaataatacaggaagagagcgaaaaatgttactccaggacacaaaagagaactgtcaaactgacattatgaagtaggcaaaaggggacaggatctagtgcatgagtagaaacactggctttaaataagaatattagtacttaactaggatcttgatacatatttgctgaaagaacaaaatctttggctactaaaacaacagaaagtggcaagtataaacagtaaatactaactttgctgtaacagatgatataggaattcggaagtacatctgttagataacttttcctatttcttttgcccttattcctttgccacaaactactcttcaatattaactttagctctcctctttgaccaataaaaaatatccaagtttatttctcttcaaatatggatcaaaagataaaagctctaggttaagggaagagaatatagaaccaacttaccattttcatctactgcaagcacacttgctccttttcccaaaagttcctgaaccaccattgttagcccatttcgggcagcaacatgcagaggtctaggggaaaaaacatgatacatgtacacatatgtgcatgtgcatgcacatacacatacacacctggctgtcaaagagcatttttgtcaacttgtgaagaccaagaggtacaaactcgagaaacctagtcctaataacaaagatgggggcagggagagcagaacctctgtgcagtgcactgtcacaccttgtcaacgtgtagctcggcatcaagctcagccataggtcccatcgacaggtccctaccttcacccaatccttttgttacttttcttttcaatgtttaaaaacattttaccattgaaattgcattcctccgttgttaaggaatgaggctggtaaagatacagactatacattaaaaactgtaaactgcagtagcataaattctaataggctttgaaaacagcttacaagcatcatgactaatttttggaccttcaagggatctgactaatcccagaacgggcaacaatattctaagatttttatctttactaaacctcaaaatggaatagcaagggacaatgagagacactgatgtaagatctctgtcagtctatctggaggttggctgctcacattattaaaaattttgattctttaagaaaccttattggcttacagacacacataaagcttcttacctcatttattgttagtttcaagtaacatattattacagttgatttccacagaatacacaaaatagtactactttccttcagaaaattaggtaggtggattaaggaaaaaaatacattattgtcaatgttataataaaatttcagttcaaaagcattttaaataatatggcttttagttgtgatcattttagaaatgagttttgacagttgtaaaactattaaaattgcttctatgactaatgaaacctattccaatagtcacatgtttaaaaaaatccatttatcatttttataattataggtcacaaagtttatactagatactgacagtactcacgtttgcaaggctgcgttggttgcattgatgaggtttctatctgttatcttttccagtattaacaaggcactagtttcatgaccctataattgtggcagataagttataaaaacttgagcaccattaaagatacatttatacacccaacaatctgcaatcctagtccatatattatgtacaacaccatacatataccatgaattttcctggctaatatcttaatatttgcccaaacacatcttgggagtgagggtaggagaagaggacaaaattaagattaaggaaagaggataattatgcttagacttgtgttccaaaacttatttggcttactggagactttgatacgccatggtgccttataagtcaattttgttcaagaaatctaataccagtgatcattagagaggtttggtcctgagttgttcattttagtgaagtcaaaaaacttttaaggtcactgttaatattaacaatggaaacatattcttaagatgtatacataccttgctacaagccaaatggagggcagtatttttactgttatcttgtaaagtcagttctgcactagcactgctaaccagcatctctgggaggaaaaagtgcatcaattcttatgtttatgaacatgtttcttagattaccaataactcactgtagagaaatgaagatacaaagcaaaaaagtccctctcacaaaaacttaagtacaagaaaaatattgtaatatataacatatatatcttcatataattgtatgagacaattatattgttgtataagtcacacactctaacaatggcaattaacatttattttgtgactgtgcactaaattttaaatactgttttatatgctctggatttaaagtaatttatttaaccctcacaacaacacaccaagtagatactgttatttttctcattttataaatgagaaaactgaggcataaggtcatttagctgaaagatctaggactcacattcaggcaatccaactccacagccagtgttcttaaccactatgttataaggccatggtaaagtagactcctcaatagtcagggcaaactaaaacattgtatccctaaatgaaaatgtggattgcaaacaggtaaaaggttttaagtcttaggagtggtaagataactagttgaagtcagaagtcttgggatctaagttatacataagtgatacacatacttaggaaaatacaattttaaagaagtttctttaccaactgtatttgtttgtccattttctgcagccatcataagaggtgttttccctgtagagtccacagaattgacttgagcattatggctgagcagcagctgtaaacactctacatggtctgtgaaggcggctgcatggagaggagttctgtgataaagaaaaattgaaatatatgactaaatttgaatgttatatatgctggaaaaatattctttaatttgtgacatgctgtttttaagggtttacatattaggctacaaaagcactgcctgtacacaaacaaataggctcaatggagcttactaatttctctcatagaaatttgtactttcaataatacagaaggctttaattaaactagaactagtatgaagtaaagattaattacaaaattgctaaaataacattacatcattaaaggaaattttgaaagaaataaatcctaatctgaataccaccacttattacaactgctggacttttttccaggctttattcccatttagaaaactgttaactttgttaacaataatctttgggaaacaaattcgaaagagagggaaaaatatttacatgttaaaatagtttaaaggaggaaaacttcctaaaatctataaatagaaaaaccttttataatgtaaaaataattgagatcttataacaatttatactcgcaaatataaaaatcaacttttaataatgggttttctgtaaattctctcacaccagccagtagttaaaatttatttcttattgaaaataaaacctttttggggggtagggcccagacgggatctcactctgtcacccaggctggaatgcagtggtgcaatcatagctcactgttgcctcaaactcctgggctcaagtgatcctcctgcctcagcctcctgaacagctgggatcacaggcatgcatcatcatgcactttttttttttttggtagagatgcaggtcttgctatgttgaccaggctggtcttaaactcctggcttcaagtcatcctcccacttcagcctcccagattgttaggattataggcatgagccactgtgcctggctaaaactatttaatacatagttgaattcctaccttccttttgaatctgtggcgttcacaatgctggcacctaatgtatcaattaacatctcagcagcaccttcgttgtcatttatcctgtgtaaggtaacaaggtgatcattctcacagcaatggtgtatttcttaaaacactcaaaccaaatctgattcattctggctttacttacacggcacaatgcaatggactaaaagcatttccttccgttttctggaaaacttcctgttctaaaagcagttctacacatgtctcgtgacctaaataggtgtaaagaaccaggtattaaaattcaaaggagatactggcaaaaatcacaggtacatgtaagtgtttaaaggaaaaatgtaaaagtctctccctcatcccatctcccagatcccctctctggaatataaccattggtagctgttaagccaccagtagttcctgaaaatttctaggcatatacaactgcacgcacaaaatacatacagttggctctctgtatccgtgggttctgcatccatcaattcaaccaaccccaaattaaaaatatttgggggaaaaaaaaaacagagcagactttttttcttgtcatataccctaaatacagcataccaattatttacataacatttacattacattggttattataagtaatccagagatgatttaaagtatagcagagaatgtgcataggttatatgcaaatactatcccattttctataagggacttgagcgcctgttggttttggtattcacaaggggtcctggaaaccaatcctcaacagcaaacgagaaatgactgtgctatttttttatttttttcttaatggcaatgggatgtttaattccgcaacttgccttttacttaatattaactacacatatccttccataatagcatatatgaaatattattattattattttagatggagtctcactctgttgcccagcctggagtgcagtggcgcgatcttggctcactgcaacctctgcctcctgggttcaagtgattctcctgtctcagcctcccaagtagctggactacaggcgcccaccaccatgcccagctagcttttttcgtatttttagtagacacggggtttcaccatgttggtcaggctgatctcaaactcctgatctcaggtgatccacctgcctcagtctcccaaagtgctgggattacaggtgtgagccaccatgcccggctaaaatcttattctttaatgttctgaagagcttcacagtatcaaagtatatcataaattatttaatctaattatggattttaaagtgattgctagtttaaaaaaattcttcatgatattatcaacaacgctgtaatgaaacattctggtatttttttattttattaaaacaattttttgagacagggtcttgctctgttgcccaagttgaagtgcagtggcatgatcatgactctctgcagtctcaacctcctgggctcaagtgatcctcccacctcagcctcctgagttgctaagacaacaggtgcaaggctaccacacctggctaattttttgatattttgtagagatgaagttttgccatgttgctcaggctggtcttgaatcccagagctcaagtgatctgcctgcctcagcctcctaaaatgctgggattacaggcataagccaccacggccaacattttgtttttattttaggaagtatttttgtaggacaatttcctaccaaagtgatattgctgtggtaaaggagaagtatccagccttggtattcttgggggattgggtccaggactccccactgacagcaaaactccatagtcccttatacaggtcccttgtacaaaatggtttatttgtgtataacctatgcacatcttctcatatactttaagtcatctctagattacttacaacttaattcaatgtaaatgctatataaatagttgttgtattgtttagggaataatgacaaaaaaaaagtctgtacatgttcagcctaactatatttctgatggacattcagttgaattcaccgatgggggacccatggatatggagggctgactgtattgactgttcatcaatatctggtccatagtttttaacagtaacttcaaaaacagaaaaatccaaatttcaaattttcttaccctaattccagagccagggttttaatttaataccctaattactacaaataaaatgttgcttattttatttcattagtcatttgggatctactttaggaataagattcttacatggcctctttatacattttcatggtttaatatttgcctaccaaagtgatgttatattttcttttctttttaaattactcaaacttaatcagcttaaactttaccctataattgtggaaaagtaatttttagaaaaacctgtaattgtgttccatcttttgtcagttcttttctctaatctagtagttttcaagtggattttgcccatcagcagatattgtatgtggcaatgcctacagacatttttgtttatcacaactgaaggtggggcagtgcaactggcatctagtgggtagaaaccaatgatgctgctaaacatcttgcaatgcactggagagtcccttgcaacaatcatctggcccaaaacgtcatagtgctgaggttgagaaactcctttaatgccatcgttctgaatgttaactcattactaagatacagcaatggaaagttgtccattgttgacttaagagcccctcattctccaggtatatgggttcttaaggtgtggcctagggaaccctggggtgacgcaaaaaaaatatgaataaaaacacagatgagaacccaactattctcttaaattagctatgaagagatgtactactcttctcactaaaaagaaaatacttttggaaaatagttttcataaaaaaagattatttatgttaacatgtaatagacattatttttaaataaatcagtaagtatttaaaaatttctcaattacaatttctaatacagtcagtatcaatccatagttcctgagaccaaagggtttgagaaccactcaccatctgagtacagactgagaaaagggaacagtggggcccctttgtgacctccagaaatcattactgggtgatatcaagcagacaatctcataactttctatcatcatttatgaaagatagataggatggtaaactgggtcctcctgagtttcagaggctagtctgaggatgtttagagcttcataaaaatgaacacattttttaaaggaataataagtattcttaagttctgtgattgaatgactatataaactgaaattgtgaacttttagtatctacagccagtgtttttctaaaacttggccatcatttcattttaattttaagaggttgttttctgttctgttggcatgcttccacttttctttccagctgtacaataattactagttaaagtaaaaaccattttacatattctactttcagaatgccaaattataaaacgggcttttggctataaatatggtattaattttaggctgtctatatagtcgcttattgcatatagccaacacacattaaattccttccagctcaaattcagcatcaccacaattttgctacaggctgaaaatcagacacatttgttatgatctttaaatggcaaccaggcatgcagttcttgcaaaattctgtctcttgcacaaaacgtgcttagagtctaaatttagcagtgatagagtaggaactcactttagggaaaatgttctacatatagatctgataacaaacactgtaatagaaagcaactctccaaaggacagttacagcagtacatttacaactaaatgctcttcctgaggaaaaatatctcactgtgtgatttttccaatggttaatcttcagggatatatttttttaaaaaccaagcagtaagtctttgcttctgaacagttttatctcactgacttttttacagaaacacaactcacaattgtagatattttcccactatattagatattttgggttttccttatacttgtaaaatgtcaagtcacattacagaaacaaatcaaacatcaatggcaaaatacagtatcttctttgttctagtatgagtactagtctctggccacttcactacactcatttctacttgccttagcgagtagaaatgggaaaaagagaagttaaaccccaaaggttttatagttttcaaaactgttttggttaaggatttaaggtagtaaaaaacaaagagactaaactagcttgttcaatgagcaacagatttaactattcaagtttttatggtgctatcagtactcagctgaaggataaccaacagtataacaggacaaacctcaagaacccaaaatgttctaacggcaaaagaatacaactcccaactttggcataaggactaatatgaaaatcaaaatattgtatctcagaaatacttgtggaaacatttaatgaagttataattttacaagattcagctttttcctcttttgctttaacttgataactttgtcagaacagctcccagtgaaagaactatgaaacagcatattatagaaagataggaaatctcaacttcctggtaaggcagtctgattttacaacagatattatacttatttatttttagcaaatgggtatttatataaagagacaacttatattttctctgcattttgagggaaggttattagaattgtgaactacagctttgtagatctgctgtcataattaacattaatcttgaagctacactgaaattgaaaacaaattttaaaaacctctaatttctctactaaagcctgaagcttgaactttgacaacactgatgcttgcactgtatataatgtacttgagttttctaagatgatcaaatctaaaaatatctcaacatgcttcattgcataaattattttaattagtggcatttcataagccaaactgcatttttaacatctataacttcaaagtagctttatgcttccctacgtgaccttttatgagtctacctataaaagcgatgactgtgactgtgagcctgtaggaggccaaagaaaatctcttttaaccatgtagcagagttaacccatcaaagtttctaattctaagacctgctagggatttattcctttaaaacattgaacatggatattactggtaatataagaatgttatcttgcaatgtgctcagaaaacatacatagatttcagtttagaatgtgatacatctcactgtttctcctacttttggttatttttcccctaatatgattgtatttagaaagtaaaagaacatggctgggtgcaatggctcatgcctgtaatcctagcacttggggagtctgatgtgggaggattgcttaagcccagttgttcaagaccagcctgggcaacatagtgggactcttaaaaaaaaaaaaatagtaaaagaacacaatcaaaatacaagcacactatataaaagcaatggaaacattctaaaaacctcctaaaaatgcaaaatatttgtggaaataaggatctaagaaaaacttcaggctacatggtggctcatgcctgtaatcccaacactttgggaggctgaggtgggaggatcacttgatgccaggagttcaagaccagcctgggcaacatagcaagatcctaccaaaactaaaaaagaaaagaaaagaaaagaaaaacctcaaaaatacttcatggcttatctcagaacacctttgacaactagtgtcttggctttagcatgacaaaggacaggagtgagcctacgtactaagtattattagtacgtgagcctatacagtagattattcccaaggtttttgctaattttaaacttaaaatttgccttataaatatgtcattcttttatctctgttcactacacaatgatatgcatttgtgtttgtatacttaaccattgtagcaagcccagtgaagtgccgtatatccatgattgtctgctgtggctggatttgcatccatagatgctgctgactgcaaaagggctccaagaacaccaatgtgtccacaggcagcagacaggtgtataggcgtccggcccctgctatcccgaagtaagcacttagcaccatgttgaagtaatgcatctacacattcttcatggcctgtaactgcctgaaagaaaataatttaaaggtagtcaaacatattatgctaaacattacatgccaatttcagctaattaaaaactttaaagaccatactctccatatccttccatcaattaaagccatttatcattttatgagtaattctgtatttttattggaagtggtttaaaaattcagttaaagcaagaacccttctaaaatgcaaatagtatgaaaacaggaagagagaaacttggtattcaatgaaaataatgatatttcaaaggtgaaaaaagattaaagtgtataagaaaataagtgagataatggaaaaagtcaaattgacattaattctactaaaagttttagagttttaaaattttgttctaacattgttctctagattaagttgtactctgtaattgttcaaaattagcatttaaaaactaagatactgaaagaaatggtaaagactatttgacgaacatttaatgaagaaaaaataaacataacctagttcagttctaggtaatatgaggtcataaaagctttttgaaaggaaagagcatatttctgcttacccctctatgcaacgctgtccttccccacttatctttggcatctacatttgctcctttgttcagcaatgagtaaacacagtctgtgtgcccgttgagaacagatagcatcagaggcgtcctgagcaacaacaggaataggttcagtgctgtcacttaagactgtactctggttttcgaaatacgcccttctgtgatgcaacaattatttatcgaaacttactgtccatttccatcttgaatatccactgcattctgtggttctgcatttcctattaatagccgtaagcattctgaatgaccatttgttgctgtaaagtgaaatttaaacatttcagtaattacatataatgataaaatagaaaatgtccatctaaaagcacatcttctagaatttacttttgggatagttgcactgaatttaatatgcaagaatgaaaactataggtaaaaagaaggtttctacggcctttgactgttaaagctggaataaatgtgaattcctcacagtaaaacatgacaggcagaccgcctacccagcacccatgccctatcatctgcctctaaaagaatgctcattttatttagctctctggcaatgtggtcaggaagagtgccttgactccagcaaagggatgataccatgattagaccaagtcaatcacaagaaccccattctcctctgacagtgatcagttttaaggtgagcagcacaggaaccaggtctgactactgagatgccgataagtctagaggctgctgggaaatacttttatctttaataatgaaaagcccccattccttcctgattttagatgcaatccttaaaagcagcagcaataatcccacaacatgaatgcaaatgtaagagaataacagaatttaatccagagctctgacaccgttgtagaatcaaccaaccctggaactgcatctgcctgatattgctttttttttttttttgagacagaatctcgctctgtcgcccaggctggagtgtagtggtgtgatcttggctcactgcaacttccgcctcctgggttcaagcaattctctgcctcagcctcccaagtagctgggattacaggcgcctgccaccacacccggcgattttttttgtatttttaggagagatgaggtttcaccatctaggcatggctggtcttgaactcctgacctcatgatccacccacctcggcctcccaaagtgctgggattacaggcatgagccaccgtgcccagcctgcctttcgacattgtatatgagacactaaaccccttaagctattttcagtagggtactctgttatttatggctgaaataatttcaaatgatatatatatatatacatacagtacaagaaaaatgatccatctaaagaatgcatgtgttaagtccaaatgcataaaatgggcaagggtacaagtagaagtagtccaaagaaaagagcttttgaagtaagttaaatcctctgcaaaattcaggtcctgttaatatatacaaagtctgaagtttaaagaaatacattagaaaaaaatgtatcttgcatatgatacagaaaagaacgtctatcactatttcttctaattaaaagatgacaaaactagcaaaagcaagctaggtgctgaatattccacagtatgttcccacagttatattaaatactaatagttattaaacttgtggcttaaatcacctctcctaccctagtccaatctgtatgctgcactctgccagcagctctcacagcttagcaacaaaaaacagggtcgtaacacttggggatgttcaagaagaacttgtttggcccatcatttttcaaatcagttcatttacactcagttcacagtcgctactgatgaatgtttgtgtcatctaagttcaatacccaaacagcaagcacagcatctctgtgggaaatgactggtaaacctccaggaaaaaaaaccctcagtgttcttttcatggcttatagatgctctctatagacctccaaatttgaaaggcatctatagatacaaggcttgcatttattgaatagataggcactaagagtaacctgtggttctttttgtgggtaggatttatgctgaactatatggcattggttaactacttctaagggactggctaatgtctcagttcaatatttacctattgagagtgcaaccactccatgcaagctttaaattagttctgcatatgatctgcaattataatttttctagctatagattaatatttttaaaatgtacttatttttcacagatcccatccagtgtacaaaattgatttttattttatattttaggaacagggtttcatcatgttgcctagagtgcaatgaaactgaactcaagtgaccctcttgcctcagcctcccaagttaggtgggaatacaggcatgcgccaccaagtttggctttgcaaagtgatatataacttcactctttttcagaataaggtaacagcaagtaatgcattttaacctcttgttcaaaccatatagtagtgtatatatgtttattagaggttctaatgtattattaaaatatttttctcagccccacttgaacatctgatagctttgaagggcggctctgggagtaacagtgggtgttatcaatagtcttctaaaatgtaagcttcccaaaggactagaaaaaaaatccaagacatatattcaaatgtattcttaaggatcactctataaaaatagagagttgtgaatctgcatctgccagtgatacgcagtgggtagcaagtcatttaactgacttggttatagaccttcgtattttaacgtatctgctacatcataatatcacaatatggaatagttcttgcataaagtgctctgtaaagcctgtctgcataaatgtttaatgcagtacactggtaaaataagtcaaaacgtgtatcacttgttaaatgaaagattataccaatccaaaataacttctaccagaaagaaataaatactgcattgttttgttgataaagtgtttcagaagttagattattacataaacccaacttctaaggcagataatgttttaagtgatgatagtcttgttgttggtattccctgagaatacaatcattttaccacttaaagtcaaaaatttccccagacagttgtagctcttggtaatctccttgggtctggaaacttttgaagagccaagctgacatttttcagctctttgggccactgggttttagagggagaagtccagagataagtccaggctgtagcacaaccttcaaaacaacacaggcgcctctctgatcctgccctacctaagctttgacggtagtggggcttctgtctggagaaatgccttcaaagagtaaccagtaggtgtgacatagaattggccaatgttagcatctgcagccatcatcaaaagatgaatccactgccactgccccctgaggggcccctaaaattgcagaaggtatcagcaaggaggctgccaaggttgttttccaagagaggccacaggaggaagggagctacttgggggcacttacatcttttgtgcagaggagcttcttttcatgagagcaggacagttttaatgacttcttaaacacttgtgtgggacaggctggagcatgagggaggttttaagccaggcacaaagttagtttcaaacactagttaataaatctatttttatttcctttttcacacagaagctggtagtctaggacctacatgtaaacaactttatatgaatattttttgtgcttggtttacttgggttgatataatacactgtatttaagttccctgaacactgggatactcctaatgtttatgaatgacggaggctttgtaaattcatttgtgtgaataaagttatttggtgaggtcaaataatccatatatgatttgaaaaaaaaaaaggtcaaaattttaaagacaattaactggaaatattatatatcagaaattgaaaaaaagtattggatagaagttataaataaatcaagcataatatctggcatacctgctgcatgaataggtgtcctcttcaaaatgtaatcttttactaagattgaggctccctgattaatgagtacatccacacattcaacatggcccttaaaagctgcaagatctaggggtgttcttccactactatttctgacatcaagatctaacaaagactgtaccaacacttccagtgcttgatggtgaccatgataggcctagaaataaataaaaatgtaaatttaaaacatacatatttagactgacttcctaaatacttgaataaatgtaaataagcaaacttgtcttcatattattatcctacttgagataatccaaacttctacatcgagaattcaggaagttaactacagatctttctaataatcaacatagtaggctactgtgttagggaacaggcattctaaaaataatacaagttcaaatgacaggtcatcttttcatgagtatacaatgcttggctcacggcagacattcaatggatgtgtgacacggattcatttaaagtcttgatttcaagtctgattctaaaaagcctgtgttttttttgttttgttttgagacagggtcttgctctgttgccccagctggagtccagtggcgtgatcatagctcactgcagccttgaccttctgggcttaagtgatcctcccacctcagcctcctgagtagcagggaccagaggtacacgtcaccatgcccagctaatttttcttttaatttttgtagtgatgagggtctcgctatgctatccgggctggtctcaaaattcctggcctcaagtcatcctcctaccttggtctctcaaagtgctaggaatacaggcatgagccactgtgcccagccaagcctgtgttcttaatcacagttcagtgctccacatcaactgcaaagacagctagcaacttgagtcagtgcttgaatattcggatttctcaaattaaactgaccatacccaccccataatgtgccatagctaaaaaagaagtaattcttttagcaaagaaatgcataaccgagccctgcttgaatatcaccacataccaggcattgtcctagctgtacaaaagtaagactgaagatttgtcagactgaagttgtcttttttttttttttttgagacggagtctcactctgtcaccaggctggagtgcagtggcacaatctcagctcactgcaacctccgcctccctgggttcaagcgattctcctgtctcagtctcccgagtagctgggattacaggcgcatgccaccatgccccagctaatttttgtatttttagtagaaacggggtttcaccatgttggccaggatggtctcgatctcttgaccttgtgatccgcccgcctcggcctcccaaagtgctgggattacaggcgtgagccactgcgcccggccccgagttgccttcttcatacagtctaataaaagggctttccagaaaagtcttttcaaaatccaacatggcaactgaacatatattatttacactggactaaatgctgagcaggacataaagaaataaataaacttcaaaggactataatgccatttcttgtagaaaatgtcagaaagtagcagcaagagataaacttgctctgggcctcactgatctctttataatgaatctgtgtagaaacttgactacttaagcttgactatctcaaagattaaagtgactgtaggtcacggaattctactgttttaggattacatctaactttgttcctcaatactaggtcaatgaaaattatgctactgaaagaatgaactctgaggaatcatacattaaatataaaagacaatataaaaagaagagtttagccagttgtggtggctcacacctataatcccagcactttggggaggctgaggtggaaggatcatttgaacaggagtttggggccagcctgagcaacacagtgagatctcatctctgccaaaaataaataaacaaacaaataaataagctggacctggtggcacatgcctgtggtcccagctatgcaggaggctgaggcggaagtatcacttgagtctaggaggtacaggctgcagtgagctgggaatgcaccactgcaacccagcctgggtgacagaatgagattgtatctctaaataaaaaaaaaaaaaaaaaaaaaatgaggttgggcatggtcactcacacctatatctcagcactttggcaggccaacacaggaggattacttgaggccaggagtttgagactagcctgggcaacagtgagaccttgtctctacaaaaaaataaagaattagtcgggaatggtggtgtgcacctatagtcctagctactcagaaggctgagggagggaggctcactggagctcaggaattcaagactgtagtgagccgtgattgtgccactacactccagcctggatgacagagtgagacaatgaaaaacaacagcaaaaataaataaaaaataaaaatgaaaagacaagagaaataaatgggagccatgatgatttgccacagggcttttccccccatgatatccttgtatgggactgagagaagaagtccaaatgtccagtatgactaaaattaggaatcaaggccagtctccttaagcctcagatcagtatgttttcactgtaccaagttgtcccgaatgggagagtttcgtgtaagaaattaaagtaacttctgaaaacctcctagagatagatatgaaatgcaaaagtggtggtataatcatatttcattaagcctaatcactaaattatttcaatttttagtttaaaaacactatttagtatacctatggcatagcagcacttattcataatagccaagagaagaaagcaacccagcatctattgtcagatgaatggataaagaaaaatgtgctatatacataacaataattattcagcttaaaaataaggaaattcagccacatgctacaacatggatgaaacctgctagatgaaataagccagtcacacaacacaaaaaaatactgttatgattccacttaaatgaggtgtctagattagtcaaattcataggaacagaaggtaggctagtattaccagggactggggaaaggagaaacagggagatgtttaatgggtacagagttttagttttaacctttacaagataaaaagattctggagattggttgtacagtaatgtaaatatacttaacactgctgaactgtacaattagaaatggttaagaaggtacgttttatgctatgttttcttttttctaccattaccaccatatacacatacaaaatctctgacaaaaaaatagtaatgggggggcagagagagagagagagagagagaccgacccactaatcaatgtatagcacactgttaacttgcaagcacaaaaagagaaacttgccaaattgaagggtggggtagaatacaaatgagaatttctaaggaaacaacatcattaaactgataactaagtcctaaagactgcagggcttttgggagtctttaatatgctactagttgaatctccacaaggcggaaatagtctggcacctagaaagtgctcaagaaatgacagtgaaattattataatgagaatgctgctgctgctgctgctgctaatgctgctcagtcttcatttcttttcatcaatagtaaaatggctatttcttccatgctggctttgccttttcagacttatttactatgcatgtctgggagaggtgatggtgtttccaaggactcaaagggcaaagaagtagaaagcttcaagaatgctttcttagttatttagaacatgataggaagtatcagtagggagaaatggcagaaaatttaatgtatatatgtcagtgttaaaacacccgcaaggagaatattaagataaaaaataatagtacatatgaaaagaaacaatcaaatgaataactgaacttgtagtgttccacattaaattaaggatacatccttataagcattttactaaaaatcatggatctcacaaacacctggtgagagtaccctggtctcctgattctcaaagtacccccttccctacaactctaacatgctttgtctcaaaaataaattctttctgtacaggaagctagattaggatctacttgaaatttaaggtaataaattctcatttgacttaaaaaattgtcacattcttccctaaccttctccatttagtgattgacactgaaaaaaaatttagaggaatcttaaagtggaagggacataacagacaatgtagccaaatcctatagtgtgagcaactaaaggaccagtgaacacacaacaagttagcaccccaagatcacaaagtaagcaaaaaattgtagaaataccacagaatgtgtgtgtataccatctgcttagccaacttataaggcattccactagggcagcacattttaaaattcaccatcacaggcatattctccatattttctccctttctctccccagaaggccctgggggaagcctaaggatcactgtctgtcttttttttttttttctaaagcaagaaacagaaaaaacaaaaacaaaaacccagcacattaagtaattctctgaattaaagaaagttctcaaagttttaattccatgataactattacatggaccaaaagtttatggtactagtttgagtcaacacaaataggttattagatattttcagtaaaccagcagccatcaagtcggctatgaaggcagtactcacagccaagtgtaaagggcttattgttgctctattatctgaatcactcagcatgtctgttcctgaggtttccattaactgaaaaagaagaggcattttaaatgtcagaaagacatactacagcaattattctctcccacccacccagttcaaatccaccttagagtattatttggcaactcagcaaacttataaaacatgattattatgaaagtatactaaggaccacagactaagagctttgaagacaggcataagagtttgggggaaatgctacttaattgccaccaagtaaacatcttcctttcctctgtacacatgatttctgtcaccgtctttgtgcctaatatgtaaaaacactttcagctctaatgagagcaaacagataaacataactggtaggagggaactgaccaatactaattggtgggagggaattgactaatacttacaacatctagaggagtttcacttgcaatctgaaataaaagtcaaaacaaaaatatttagcttgggaagtattcatctatattaagtctcaacttatatagagctttgctaacttttaccctaaacccgtgcttcctttggctccaaaaaattaggtgttttgaataaacaattttatatcacaacagacgtcaaatctatatacataggtctaaaattttggtgtgaatatccataacgtaggaaaatagttatttttgtagcagggctctaagtgctatattaaattgtcaacctcccttttcttgttttatatctacgctcgttgaattttatttccccttgaagggaagcaaagtttaatgtaatttataaggtaagtctaaataagagcatctttaacctaaagtatctgttacacacatgaatatcttttccttgactttccttctggtttggtaaatttgggtgaatggtggtattctattccagaatcagaccacagcagaaataaaaacgtcctctgcagaagtggagtctcccttgttaggaggggttgtgaaataaatgtgccttttggaattccctaaatatatgggggagatattcctttcacagggacttttatttctcacaaaagacacagttatagttttttagaaacttatgaggaatattaatttaaaggggcaggagaagtaaatagtgtagacatgaacatggggtaatcagtagccctcttcagagatctaattttctccttttttaaaaggaaaagagaatgagatatatcttactaaagcaagtgtgaatttaagaggtatataaattctgaaaatgttaaaaaacaaaatggaatttgttccttgatccatttattctcatttttgttacattattagactataaactcccattaggtctttcacaagaattcaggaatcttaccagctgaagacatagacggtgaccataagcagctgaataatgaactgcgttgtatccttgcttatcacggatccctggatttgcatcgtttcttaataagtattccaggcacctatatacaacaacaacaacatactgaaaatcctaaatcctgcatattaaccaatgataaaaagagactgaaattaaaaactgacaatttttcttatacttgagtaatataaaaatcataaatgtattacactataaaaatgtcatttaaatgacactgactaaagtatcataaaaatgcaaatgaaacattcatgagaatcttcttgattcaaagtggatacctcaaaagtctgtcagacagctttttttttcatatgtgaaggctatcttttacacagtctctatctataccaccacctattctactaaacaatgttggataggattaaacttttcgtggtggtgagtacataatattggcaatattactatttatctatctagaacacagaatgagtaaatttttcatcatgaagctcaagaaaggatgttaaacaaaacaaaacctcaagaaaccaaggtcagaactcaatgaatctgaattagaggactaagaagaggtatataaacagagtaaagtggtaagaaggtatccataagagatacttcatttcatttctgtgataataaaatatgaggaaaataattttaaaaaacactatatgtaaaaccactatggaaaactgtatggagattccttaaggaacaaaaagtaacactaccatttgatccagcaatcccattactgagtatctacccaggggaaaagaagtcattatttgaaaaaggcacttgcacatgcatgtttatagcagtacaattcgcaattgcaaaaatatgaaacaagtctatttaggctatctatcaacgaacgagtgcgtaaagaaaatgtggtatatatacaccatggaatactattcagacatagaaaggaacaaaataatagcatttgcagcaacctggagttggagatcattattctaagtgaagcaattcagggatggaaaacgaatatcgtatgttctcgctcataagtgggagctatgaggagacgcgaaggcacaaaaatgatagaatggactttggggactcagggggaagttcccaaattgtacccaatatgtagtcttttatccatcatattttactccatgtgagggataaaagactacacattggatacagtgtacattgctcaggggaccagtgcaccaaaatctcagaaatcatcaataaagaacttatctatgtaaccaaaaaccacctgttccccaggaactattgaaataaaatacaataaaaataaatttaatcatgtgtttgttttttttttgccattggttctgtttatgtgatggattacgtgtattgatttgcgtacgttgaaccagccttgcatcccagggatgaagccgagttgattgtggtgggtaagctttttgatatgctgctggattcagtttgccagtattttattgaggattttcgcattgatgttcatcagggatattggcctaaaattctcaaggctttggtatcaggatgatgctggcctcataaaatgagttagggaggattccctctttttctattgtttggaatagtttcagaaggaatggtaccagctcctctttgtacctctggtagaattcggctgtgaatccatctggtcctggacttttatttgtttggtaggctattaattattgcctcaatttcagaacctgttatttgtctattcagagattcaacttcttcctggtttagtcttgggagggtgtatatgtccaagaatttatccctttcttctagattttctagtttatttgcgtagaggtgtttatagtattctctgattgtagtttgtatttctttgagctcggtggtgatattccctttatgtgtctatttgaatcttctcttttcttcttcattagtcttgctagcggtctgtctgattatctcaatagatgcagaaaaggccttcgacaaaattcaacagcacttcatgctaaaaactctcaataaactaggtattgatggaatgtatctcaaaatagtaagggctagttatgacaaacccacagccaatatcatactgaatgggcaaaaactggaagcattccctttgaaaactggcacaagacagggatgccctctctcaccactcctattcaacatagtgttggaagttctggctagggcaatcaggcaagagaaagaaataaagggtattcaattaggaaaagaggaagtcaaattgtctctgtttgcagatgacatgaatgtatatttagaaaaccccatcgtctcagctcaaaatctccttaagctgataagcaacttcagcaaagtctcaggatacaaaatcaatgtgcgaaaatcacaaagattcccatacaccaataacagacaaacagagagccaaatcatgagtgaactcccattcacaactgctacaaagagagtaaaatacctaggaatccaacttacaggggatgtgaaggacctcttcaggcagaactacaaaccactgctcaatgaaataaaagaggacataaacaaatggaagaacattccatgctcatggacaggaagaatcaatattgtgaaaatggccatactacccgaggtactttatagattgaatgccatccccatcaagctaccaatgactttcttcacagaattggaaaaaactactttaaagttcatatggaaccaaaaaagagcccgcattgccaagacaatcctaagccaaaagaacaaagctggaagcatcatgctacctgacttcaaactacactacaaggctacagtaaccaaaacagcatggtactggtagcaaaagaggtatatagaacaatggaacagaacagaggcctcagaaataacaccacacatctacaaccatctgatttttgacaaacctgacaaaaactagcaatggggaaaggatttcttatttaataaatggtgctgggaaaactggctagccatatgtagaaagctgaaactggatcccttccttacactatatacaaaaattaactcaagatggattaaatacttaaatattagacctaaaaccataaaaaaccctattagaaaacctagggcataccattcagggcataggcatgggcaaagacttcatgactaaaacaccaaaagcaatagcaacagaagccaaaatagacaaatgggatctaattaaactaaagagcttctgcacagcaaaagaaactatcatcagagtgaacaggcaatctacagaatgggagaaaatttttgcaatctacccatctgacaaagggctaatatccagaatctacaaagaacttaaattcacaagaaaaaaacaaccccatgaaaaagtgggcaaaggatatgaacagacacttctcaaaagatgacatttatgcagccaatagacatacaaaaaaatgctcatcatcactggtcatcagagaaatgcaaataaaaaccacaatgagacactatctcacgccagttagaatggccatcattaaaaagtcaggaaacaacagatgctggagaggatgtggagaaataggcatgcttttacactgtcagtgggagtgtaaattagttcaaccattgtggaagacagtgtggtgattcctcaaggatctagaactagaaataccatttgacccagccatcccattactgggtatatacccaaaggattataaatcatgctgctataaagacacatgcacacgtatgtttactgcggcactatttgcaatagcaaagacttggaaccaacccaaatgtccatcaatgatagactggattaagaaaatgtggcacatatacaccatggaatactatgccaccataaaaaaggatgagttcatgtcctttgcagggacacagatgaagctggaaaccatcattctcagcaaactatcacaagatcagaaaaccaaacactgcatgttctcactcatacgtgggagctgaacaaggagaacacatggaggggaacattacacacacaactctcactcttaagtggaagttgagcaatgagaacatgtggacacagggaggggaacatcatacaccggggcctgtccggggtgggggcctgggggagggatagcattaggataaatacctaatgtaaataatgtaaatgatgagttgatgggtgcagcaaaccaacatggcacatgtatacctatctaacaaacctgcacgttgtgcacatgtaccctagaacttaaaagtataatgacaaaaaaaaaaaaattaattaaaaaacactatatagggccgggcgcggtggctcatgcctgtaatcccagcactttgagaggctgaggcgggcagatcatgaggccaagagatcaagaccatcctggccaacatggtgaaatcttgtctctaccaagagtacaaaaattagctgggtgtggtggcgggcgcctgtagtcccagctactcgggaggctgaggcaggagaattgcttgaactcaggaggcggaggttgcagtgagcagagatcgcgccactgcactccagcctggcgacagagtgagactgcaaaagaaacacaacagtatataggccataatttacaattttaatacattttattacagcagaaaaaaaaagcactgaaatagcactggtaccagtgatcttgggccataaaagtgaaatagcctctgtttattcatttgatacatggagaagccagctaaataatctaaagtgtattcatgttcaaattccaagtctataattattcagtgataatttgtttggtattcaaatacgtctacccaaatattaaactacctggggaaaaaattctttaatcaaatactccttattaaaagtttccaaaatcacactgaagtcatataaaaacaaatgaaaagaaattctaaagcaatgtaactgatctttcagtaactctagctcacaaatatatgagagccattatttcaatgctaacacttatttctttaaatgctgaatttcttaaaatgctttagacctcttagaaattactttcagaatcttcattgtaatatcttcaatggcagcaaatattcatccatttaagtgcaattttgatatttatgtacagctaaaattctttggagtcaagcataataaaaaaaagaagattaagctgggtgcagtggctcatgcctgtaatcccagcactttgggaagcggaggtgggcggaacacctgaggtcgggagttcaagacctgcctgaccaacatggagaaaccccatctctactaaaaatacaaaattagccaggcatggtggcacacacctgtaatcccagctcctcgggaggctgaggcaggagaatcacttgaacccaggaggcggaggttgcagtaagctgagattgcaccattgcactccagcctgggcaagaagatcaaaactccgtctcaaaaaataaataaataaataaataaaataaaaaggttaaagtgggtatcactatgataaagaaataaaataaaacccacgtctggctctaaggtaataagactggtgttttgttttgtttcacaaactaattctgaggacatgtcaggaaaaggaagtgtttcagtcagtgtgtaaactctgtacacagccttccttggtgccgaattcagaggacagtgctcactgggatgcagaaaaagcctgcaagtctgtaggaatactttacaggcaaaaacattttacccaagggcatttaaaaaaaatctttaatcaagttctctagatgttagtgataaaacagaaatgggtcttccttactgagacctgaatacaaaacttattctaatacaatttcttttattggcatacctttcagattttgctaaacaatataaattttcataattactctgggtaagcattatctctaacaaatgaaaaagattactgacactaagttaaatgacttttcccaaatccttttggctagaatatggcaaaccaaggactaaaccacctcaggtcttccctttatccattgttctatgttcccacaaagctttagaacagtggttaatcacttacagtggtaagttaactagggtgcttataaaatactgaatcacaaaattgcttgatcttgaaaatgtgaacttcattagagggtgggggcagaagagtctgtatactcttttttctgtttgcacattaacacatgttcattttatgaaacgcagacaattaagaaatgaagattctccataatctgtcctctgaaataaaatatatacacaaaatctgaaaaaatatttaaggctaaacaatattctgttacaattttttcctcaatgttaggcaaattaaatatcttcatccccactaaccacataggttaaaatcggaatgcatttcaaactatttaaatttctcctactcttaccctaccactcatgaaccctactattttgagttctgaggcaagttcagactgattcaaattcatgtgtcccatggctagtcagagccctgggtaaggaccactcagccaggaaaacagatgtggtattgtcactccaagaggccctccctcctctctactcttcccatcatggcatacaacagttcttaccaccccccaccaccccacccctggcccaaaaaatcagttttaaaaaatacaactaacctttataggaagattaggatacgtcagaactgttccaaacaattcatatatactaaaccattttaaactctacatagtcgtgacagagtttagactagtatctccatttcacagattaaataggcacagagaggttaagtaatttgctgaaggtccccatagtaaaaggcagagctagtatcaaacactgctcttacatatatatacacaataagcttaacaaggttgttgaatgtaagtcacatacaaaaggcaaatatatcttctatataccaacacaaaaaaatttaaagattgattttggtaataaaaaatatcagatacataggaataaatctcagcattacaaaacctctacacacaaaaaactgcatgatcccatttttatgaagtttgaaaacagacaaaaataaactgccattagaagtcaaaatgtagcctcatttcctaagagtgttgctatggtctaaatgtttatgtccccccacacccattcacatggtgaaattccaacctcaaggtgatgttattaggaggtggggcctttaggaggtgattaggtcaagagggcagagccctccctcatgaatgggattagtgtccttataaataaggcccaaaagagctctcattccttctaccatgtgaggatatggcaagaatatgccctcaaagaggaagtgggccttctccagacactgaatgtgctggtgccttgatattcttgacttctcagcttccagaactgtgagaaataagatttctgttgtttataagccacccagtttttggtattttgttataccagtccaaacagactaagagaattgttattgcgaagttacgatgttgctgaaacaaatatctaaaatgtggaagaggttttggaactgggtaatggatagaggacggaagagttatgaagtgcgggctagagataacaacccataaaatattttaaaaaattatatatgatatagaaaaggctttataacatataccaggacttcaactttgattaaggctgtgagggacataaaataatctacatacacacagagcaatataactgttgatgatggttatctcaggagagctggtatgaggggaatttcttccttataatcaggaaaaacagccctcaacctttccttctcttatatacatactacacacaggtgtggagaagacccacatgacatcctgctcaaagacagccctatacgtatctgcaacaggcaaatataattttatttattaatatttcacatatttaatatgttcattgcgatagcagccatatatttgtttgctggattcttacatgatgtaaaataaagacacttcagaggacttgctgaatgactgtctaccaagaacgcaggcatcaggacaatgggggtaacaagcagaatgactagaatgagtcacggaagatttcatgtatttttccaattatttactcaaagtgaggatgaagggataaaaggcagagcagaattataattactgtatgttggtcctaaacaaaagaaaaccaatgtcagattgttaaaaattccaaagtataaacaacaacttttcctggggagctttaaaggtagaaactgtgatgctgacaggggatttttaaaaaaccatttaaaaaacaaataagcaaatgtacattactgaataatagcaattggaagctctgaggaatttgtctcttcttttagaaaatatttcattgttgctttggcagaatgagttatgcctgattctcttattactcaagctattcctgggaatacaattacaattgggtacaattgtacccaatttaagaaaaatattttttacaatttaagaaaaataaatcctttaatgccactgtttaagcctccaaaacaatcacttattaaaaggatgcctctggtatcccagaataattactgtggcttatattttccactaggctcccatggaacaaatcattgaatcaataaatgatggcactcgacaggctctctgggattttgatacttaataaagataggaaacagaggctcccattaacagtgctagattatgcacagtctcatttagttttcccagcaactctaacagggaggtttcattttccttttacaaataaagaatattttggcttagcaattacttgctcatactcaaatgggtacagtatggaaactccaagatttaaattgggtctttcggatcccaagtatcaagcctgatactttccagtgtatcaggctgtttagtgtacatactgaggattaaatatttaaataataaaagtcattgcttacttgctcaaaaccgtttatattcagtaagaaaactagtgattttagtactagtacccttctataggaaaagtagattggcttacaatgaaaccacacatctccaacactatgggttgaattatatgttattcctttgtggttttgtgtgtgtgtgaattcaggtttagtgcatttgtctaagggcagaaggatcaaagtgtaatctttttttgggggaaggaatgtgggagacaatctctcagcggaatctggatcatgctgagctgtacccaataaccagtctgtgaaagtagtggtaaaggactacagatggtgataaaaggtataacttattttaagcaaatcaataaatcaaaccatgaaattataaaactgataaattagggataagctacttatccaagtttaccaaaatattttctgatttatagtctttatcacagattttatttaaatagttgctatctaaaaacatactttatattcttgcaaataaaatacacattactattgcctttaagattagaattttaggctgggcgcagtggctcactcctgtaatcccagcattttggaaggccaaggtgggcggatcacttaggtcaggagtttgagaccagcctggccaacatggtgaatctgtctctactaaaattacaaaaattagccaggcatggtggcaggcacctgtagtcccagctactcaggaggctgaggcaggagaattgcttgtgaacctgggaggtggaagctgcagtaaactgagactgcagcactgcactccaccctgggcgacaaagcaagattccatctcaaaacgaaacaaaacaacaaacaacaaaaaaacccacaaaaacaaacaaaaaacccctagaattttttttttgtgtgtgtgtgattctgaaatcttttttttattgttatactttgttctagagtacctgtgcacaatatgcaggtttggcacatatgtatacatgtgccacgttggtgtgctgcacccattaactcgtcacttacattaggtatacctcctaatgctatccctccccctcctccccaccccatgacaggccccggtgtgtgatgttccccttcctgtgtccaagtgttcttattgttcaattctcacctatgagtgagaacatgtggtgtttggttttttgtccttgcgatagtttgctcagaatgatgtttccagcttcatccatgttcctacaaaggacataaactcctccttttttatggctgcatagtattccatgatgtatatgtgccacattttcttaatccagtctatcattgatggacatttggggtggttccaagtctttgctattgtgaatagtgtcacaataaacatacgtgtgcatgtgtctttatagcagcatgatttataatcctttgggtatatacccagtaatgggatggctgggtcaaatggtatttctagttctagatccttgatgaatcgccacactgtcttccacaatggttgaactagtttatagtcccaccaacagtataaaagtgttcctatttctccacatcctctccagcacctgttgtttcctgactttttaatgattgccattctaactggtgtgagatggtatctcactgtggtttttatttgcatttctctgatgaccagtgatgatgagcattttttcatgtgtctgttggctgcataaatgtcttctttagagaagtgtctgttcatatccttcacccaatttttgatggggttgtttgaaaaacccctagaattttagccacaatccaacataaaaaaagttacttataaaaatggttttgaaattaaagagtttatactaaattaacatttgtgaagaatcaaattatgcttcttattttgagggcgaaaagtaaatgttaaaaaccgaataaataattctgttatatgaagtacattttataacatctttccccagaaaccattacttatttctgccaatggtatttttacttttcactgacccacaccatagggaattaccagacactgaaaatcttttctgttttcaatgagtttattttcgtgcaagaagaaaaaaaaaatatgtatcaaggtattacagataggtctgataactttaggtgaatattattatacttatgaaacagtttatgcatcatttattcttgttttcacttattcattcttggccaacatttacttattctgccatctaatttacctatttaagcaacatgtagtacctactacgtaccagattctgccagttcaattactaccttttggacaccaatttacaagggttccttgcaaatctgaactgtctacctctgaaggatacttgtattccaacctctacccaatcttctgatgacattactcatatatctcctctctccctttccccatgatatagtcacggctgtagcctctaagaagtcaggtggaaaaaaacataaaagtgatattaagatgctcttttggcagataggacaagaagggacctttatctttcttccaccagatcagctagtaaggctggtgctgagaataggtagtaataactatgatttatcaataactatgaaaccaatctatttcccaaaatagacttagggcaaagataatcaacaaaaaatacaaagaggaaacacaaatttgcaacaaaaacatccatatggaagatgccagtttatagaaatattgatcctccactctcactcctatggtacttacttgccatctgtgtctgatgtagctgcatagtgcaggggtgtgcagcctctttcatcaaggtcattcacacttgctcctgatcccacaagagcaaacaggcactggtaattgcagttggcagcagcgtagtgcagtggagatcttttgggtccaagttaatacaagaaagataaaagccagagacataactagtaaacaaaagcatagttgactcttactcctcccagttacaaatactttatttacagtgagacttagactaccatatactaagtcttgcggaggactggacataaagctagaagaagaaagcaaggtggcagagaacctttaagtatatgaaataagatgaaaatgcagttatttcatcgcctccaggcagtagcagcaatcccagtcccagtcctttgagtgactttcaaataaccttcatattctgctcagaaatgtgaaaactttcattttaggaaagtttcccctacattaataaaaatgttccacagtacagaggtagcaatttctattcatgtctcagaagaagaacaaaaggtaagagaaaaaaatagaagaaacattaaaaaaaatgtaattaaccctgaattactttcaaccctctcaactcaaagcatttttcagaagccctctctgttatttgtagtatagaatgcctgaagtactaaaaattaatataaactggattaaagtataattataaaagcaaattagctataaaaatattgcattccaaagccaaagtgatttttttatttttgtgggtcattagttctttccattaagtaggcttatgagagcaatctgttcttcaaagtaattatggtgtcaaatagtttttattttcttctattcatttctgatttcctaccatgcataattctttttacttctcttctgcactggttctatcacatgcattgacatatattcacacattttcttctgacatacacccttccttctcatacactttgctatgtataattctcaaactgttgacacacacagttttgcttatactgtcatctctttcaaaccaattccaactgccttcaattctttcctgtatggttctaatgcactctgtgtcaattcctactctaagtaacttaacagtagttttaaatactgctaccacaaatactcaacaatgaggcctgctgaatgactacaaagactgtcatttcacagctgccttcctgttgtgaaatacttagtgggatgtgtggatatatgtgtgtgagagatttatatagaagaggagaaagaaaaattacacatatatatttataacctatttcctccctcttactactgctctggaacaagatatgggcagtagaatccctcaccaagaaatgacttggagaaaggagaactgtatcattattttctaggtattgtgagtttcttgaaaaaacataggttctatggggctttacatttccatagtcataatttttggagggggggaagtgatagcaagtatagaggcatttataaggccaaggctgtggttggtaggctagggctgtggtagggactcaagaagaaaactgtgggtgagaacgaatatttggaagttactgacttcagctgggactctcaatgaatcatgatcagtgtacaagatgctaaattgttcagttaattttcagaagccagttagaaggtcaatcaagttattaagtaaaaataggctccataaagaaactgtatcataccctacctcccaaatttgtcctttttattaaagtctgcaccagtattcagcagaaggtttaggcactccaaattcctattgagagaaaatacagttagaaaacttaattgacagtgattttataatgaaattggtaggtttaaagaagcatgaaagcatgtttttatatgaagataaatgtgacaaaaatgatgatttacattctatgaagaataaaacattgaaattcatcttatctagaatttagaaagttatatacttacatattggcacactgaggaaataacacacgattcatgttgtcattgtttaaaaggaagatcacatttgcaaaagagattctgaggaggctttaggaaacaacttgcttataggtttttttttttttcttgaaacagagcctcactctatagtttaggctagagtccagtgatgcaaccatagctaacggcagcctccaactcctggatataagcgatcctccaagtctcagcctcctgagtagttaagcttacagctgtgagccactgcatgagtcctgtcagctttcccttatcttctcctatactatgactgtttacatatatgtatctttagttaatactggaggaaaggatataacttaagtatttctgtaatttaactgtataaacctcaacatcaaattactatgttacaatgaaaactgtaactgtcaagtgatcagacactcaagtctgttgtccctctctctgtaggcaagttacgtggaagttaggttttaactggaaggttctctggcgaccttggaagaacaagaaaaccagtcacatgctcacaatccatctctacaacttagactgtgctggtgtactcttggttcaacgtactcgtcctctgaaatcactgaaaatttttaagaaattatcattgagaataacgtttttgcaaaatgtccttttgagaaatcatgaattaaatggcttatcacagatctaaattatcagaagcattagataagaagcatgttccagaggccatgagttttagctgaagtttgttgctcgtatgaaccaactgcctaatttttccctggtggtactatttaaaacttagtccaaaatcttccaatctcaaactttcctcttcctagtagaggtaagacacagcacaaaatgaacatttttttcctgggggaaaaaaaaattaacaaatctacttaaagagtacttgtattattcagaatattcccagtattttgatgttctcatttgagaacatactttttaaagaaatagttttacttatccagaaattatgttcttttacagaaggcagtatttccttttgtaggtttattctctctctctctctcactcataacctacaacttggctggaataagatgaaaaaaagtattctgccaccctggacttttttttcccaaacaactcctgttttgttttctattttctggcagcccagaattaataaaaaagaacaaagataagagaaaacctgccatgaccagctatcttttcttaaagaaataaaaatactattaacataccctccagctgcagctgcatgtagacaagtcctgccaaaatcatctggggtatctatatcaaatcctacaagaatgaatacatcttatttataacagacatattattttacactaaagaattgtgtcatgaaacatcaagaatcacatcctcccctccaatcccaaacaaaactatgggttcttaagtgctagagtgcctgtttaaaaggcaataggatacaatggagtattatttagcaataaaaagaaataaagtactgatactgttccatgaataacccttgagaacattatattaagtgaaacaagccagtcacagaagatcacatgttgggtgagtccatttataggaactgttcagaacaggcaaattttatagagatgaaaagtagattagtggttgcctagggctgagggaagaaagaaatggagattaactgctaatggtctttctttaacaggggatgaagaggttttctgtattttttttttttgagacagagtctcgctctgtctcctaggctagtgtgcagtggcacaatctcggcttactgcaacctctgcctcctgggttcaagcgattctcctgcctcagcctcccaagtagctgggattacaggtgctcaccaccacgcccagctaatttttttttgtattttttttttagtagagatgggctttcaccatgttggccatgctggtcttgaactcctgacctcaagtgatctgcctgtctcggcctcccaaagtgctgggattacaggcatgagccaccacgccagacctgaacccaacacgttctaaaaggggttattaaattatccatactggacccatctgcattaatttttaaaaagcaggatagagaccatctaaaaattttgaggggtttgaggagacatacaaaaggctgcaaaggttacacttacctgaagaaagaagttttctgcagcaatctgaaaagccgcttaaggctgccaaatggagggggaacattccatgtatgccacgcctaaagttaatagaacaggacagtatcttcattttaacacaagaaaaatacaatcagttaaatacattacaaagagaccacttaagtgaaagataactaagagccaaaatgtctaacacttcggagagtaatttggttaaagtttgatggtgggcataacttattagccagctatttttctccaaaagtcaggtttctcaccttcagcactactgtcattatggactttgctggggaaacgtgagaagccattctgtgcatacaggcttacaggctgttcagcagcatccctgggctctacccaatggatgtcattaacattaacaccttcctccccaaattgtgacaaccaaaaatgtatctggacatttgcttagggagcaaaattcactaccctgtcaccccaccattgaaacatttccataatgcaacatgttcaagaatatttattgtagtaattctgtaatagtgaaaaactgtaagcaacttgtatttgcaaataaggagaatgaatatattgtgaaatctttatacaataattctataaaataaatgaactagagcaacttgtacagatgtgaaagaaggcctaaatttctatctagatggctaaattaataagctcatgtaatttttttggaaaaagttacaaaacagataggtgcagtaccataccattacagaaagtaaaaaagatttaaaacttgttaatgaacacatgtaaatgtgatacaaagaatgataaacataaatttaagtatggtgtttcttgcagagcattagcaggaggactcatctttcaaacaaaatattacaatgggaactttaatttataaaataaatacaagcaaactgttctgaccaaaatgggggtgggggtaagaactccttcgtaggattccaaggaatccctgagcttggcacagcacagcctgaaaagtattatctacagatagtatttggattaaaaaaaagcatctggcacatacagctttctgggacttttaagtacttctaggttaaaaataaagagatcacaaaaattaacagctctgatcaaaactgcgttattactcaaagtgagaaagaactggggtaacatacataaaaatacactggcttaccaaataaaattgtatttaaacattttaacctaccactttgtcaatacaaaagaaagttcaagcaattaatacaacattgaggataaaatccacatttccacgtgaaatgtctagaaaactgcagttcacttccctttgtgcttgcctgtatcagttatcaacacctcggtaagtacttactttgcagtgtcagcaccacttgtaataagagtgttgatcagcagctcatggccataccgtgctgctatgtgcaaaggggtatttccattcttatcctcacagtcgattacagctcctgcaatataggacttactgtcagacactggaccatataaagatcaggtcaaacgtactacatgaaaagtaataaaaaatgctgttcacatacaaactaatagatacagcaattttaactagatttcattcatagctcatttattgggccaggcaatggatttatagcttttatacttaaagcaattgtgtgaattaagcataagattttagtagatttttaaattgacaagagggttctggggtccaataagtttggaaactactgtattaaaacaaaattaaacacgtttctttagagcaagacttcagagctttaatgtgcatactctgtcatcaagactgcatgcaatgcttcaaaaaatattggatcatgaacctatttcaacttttcccctgcaaaaccatagcacctattatcttgaggataaatttcttggaatatgccttggaaaacactgatttaaagtaatacacctaaaagttcttttgatttaaaagtttagcttgcctgatattaatttaaacacaaaagaatacaaactcaagaaattaaaatcctgaaaatagttgcagatactcaacaggggaaaatgatacatgtataatgtatatacagagtacacacattaatatataatacaaattatggtagaaagtaattttctatttagcaatattgaaaaaagctaatactaactgctgaagaaataacacagttcagggaaacaaaacataaaaaacaaaagtatgaaagatacagctacgtggtattttatactctttaatattttattttcatgagctctgaaatcatgtattaaaaatacacaaaatgcgatgacaattcctcaataccattcatttggtggatgtttttactacatttaagaaaaaaaaaaaaaaaccccaaaaaaaaaacagaaatactttttaccactctggataatggtttgtgatcgggagaatctaccgtggagagcagtcatgtgtagtggggttttcccatctttactctggggggggaagaaaaaaattactcactctactatatccataatgtgtaaaccttagttttactttgaataccctcttgcatctttatttttataactattttacatgaattaagtttaactgaggcctatggaggtaaaacagctgtttaaaattaggaattaatttttttagcacgtgtatcataaaacacaaatatacaaaaattccatgcttacaatttataaaaattgggagtgggacagtaaggatgtgtctcccaagtttcagattcaaaatttcacactgctccaacatttccattctaagaaattctgaatccttccttgaccaagtaaaagtgagtattagaattaacttcgtgaattttgtgtggatacatttaaaaaaataaatacaaataattaaaactacatatatttgtttatagttacgtgtactaaatattttctcaaatcacttaaaataataaatcagactggctgcacacatatatatttcatgtagaagttctaaaggagttccaaatatgaagaaaaacaatccctgatttaggttatcttttcttctgattaggtagtgtcttttcttttctaaaatctttcagttaaccaaaacatacatgttaccaacgcaaaggaaataaactacttagcagcttcctaatctcacagcaacattcagcatgccttctgcataggtactaaaatggaaatgtcacaagtattctaagtttatgctaacactgtacaacgcagatattctttaaaaatcctcatgtctttataataataattagaacatcataagtatctacttaagtgtttgattccataatatgaatttttcaagtaaacaagccatccaattgacaagtaattttacagaagttctaatcttttggaggcagtacgagaaaggaaggggaggaggagagaggatgcatgcatgcacaggctctggagtcagaataacctaagcatgaatctcagatctcctacttaccacaagcaagatttttggacaagttgcctaacttctttgtgccttcagttcctcaactgaaaatgaggataataccatctacatcttactggtctgttgtacagagtaaatacaataatcctttgtaaaacactcagataacacatcagtgcttctcaggatatatttgttttaccattatttttcatgtaccagttgttatttgttcaaccagaaaaaaaaagggcaaaaaagcatcttggcaaaaggattctgtctttccaaaatgttccagataggatatatcctaatttttaatgttaatattttagctatggccttttttttctctcttttttttttttgagacttgctttgttgcccaggctggagtacagtggtgtgatctcagctctcagcaacctccgcctcccgggttcaagtgattctcctgcctcagcctcctgagtagctgggattacaggcatgcaccaccatgcccagctaatttttgtattttagtagagatggggtttcaccatgttggccaggcttgtcttgaactcaagacctcaagtaatccacccgcctcggcctcccaaagtgctaggattacaggcatgagccaccgcacctggactttttttttttttttttttcccttaaagagatgggggtcttggtctgtcagccaggctggaatgcagtggtgtaatcatagttcactgcaaccttgaactctagggttcaagtgatcttctaacaacagcctctggagtagctgggactactggcatgtaacattacacctggctaatttattttttgtagagatggtctctaagttgcccaggctggttttgaactcttgggctcatgtgattctccagccttggcttcccaaagtgctgggtttacaggtgtgagccaccatgcctggccagctatagccaatttttacagacataaggaaaaacatagattccattgataagaaggataagaaaaacaagaggaaaactaactaaacaacccccacaactcaaaacaaaacaaataaaaacttgtaataataatttgattaacaaaatgatgaaatttggaagatataactatagttaacatttatgtatacatagcacgtttcacgcacagttttaaaacacttcatatggtcaggcacggtggctcatatctataattccagcgcttggggaggccaaagcggaaggactgcttgaactcaggagtttgaggctgaagtgagctatgatggtgccactgcactctgggctggtcaacagagtgagattctgtctccccatctcccttcctcctaaaaagccaaaaccaaatctacttcatatatattatttaattctcacaaccctatcagattgataccattaatcttgttttatagatgaggaaatgtaggccccagggttaagtgattttactaggtctcatagctaataagtgatgagtcctttatttatttatttatttattttgttttagagacaaggtcttgctatattgctcagactagacttgaacacctggctcaagtgattccctcacctcagccttccgaaggtagctgggactaaaggcacacacaactgggcctggttagaatcctttattataagcctatatgtggcactggatcaacatttttactttctacatactgataataaaacctattctaagtatacaaaggaaaaagagattcagattactaactaaaaagtttgccataagacacgttagcggggagaaggcacagttatttctttctgaactggagaaacaatgtggagttttctttttcttaatcacctcaaatcactttagcagaaaactaggagtattaagaaaaaaaaaaagaaaaataacaaaaaccaaaatttagagctacaaaaatcctaacagttgatctcacaggcaaccaaaaacagtaactacaagccaaacacttcacagtatttttttaggtttaaatttcaaaacaagcatttggtgtattttgcttagctgaccaaaatctattcttaaagaacaatgtgggtgggaaaacgtgtgcatataaatgaagcaatcagtgcagtaaggctcatgtcaagcagttctaaaaaacagacctatactgctttataaacctgattcattttacctctaccactttgcaggaaaatgaatttataaccttagaaactgagttattacaaacttaaattcacattccaatttctagtcatctataacttgatcaaggtcagaaacaacaaaatggagaatgtagtaggaggaaaagattaagcaggaaaaaagagataatatggtaagaatatgagggttagtaaatcaaatttttataataaagggcaagtgtaaagtgtccccatagtcaatcaataacttaataacaccgattttacaaattataaaaaatacagttgtcaggaatgaatatatattcttgctggatgaaaactcacagctatcaacatattgtgtgtaagagctggaagggatctgagaaatcaacatgggaaatgtgtttcaacaaaatttgacaataaaataattggacaattgcatataaatgagatgtcatacacccttaggtgaagttaagatgactttcgtgaaatctgttttgaaaccaacatcacaggctgttgctgtcaaatctacttaaatatatcttaatgcctttgctaaaaaattcacttgtcatatatgaaattcaccactgagttttctaaattattaaggaggtaacttcaaataggaccactggtttgagcattttactctaagtgggcctcttagaggactgattctcaattctacatttcaaaagaaaatacagacttaaaaacaatcacaggtactatagtcacctaagtagacactaacagaatcaagtgattcattatcatcaaattatattaaatattcatgccaaaatggcagtgcataaaacaggaagcccaatctctaccttttaaagacagcatcatgtgaaccaaaaaatgcatagtagctgacgacacaggtaaagttccgtaatttccataatactaacacacaaagatgattttatccacattcactatcgtaaacaggtctcacagagactgagaaaacttggttgtgacgtttgcttttgaaaatgtcaagattaattccaaatcttttatttttgaaatagcctaactttcattaaagaaacattactgcgcctttgaggaaaaaactaacttttctcctcacaactgtctagatatttttctgggccctgattatccaaagtgcaggaattcttcaaattaaaataagcagttcaaacctgtaataaataaactttctagtaattacttaaactataaaaaatgttactaggtgatttgaccgagacctaaaaacttttaaaaagatggtttagctctaatcatattagggcactttgtgacatctcatgttttttcttccttgggtgtagtatgtatacattttgtcctgtagttgagagggcaatttaaagcaatggcctaattacagatggatttgttgctgttacagctgtcagaattgacccgtggcatcattaaaggcttcactgaagttaggtgagaaaatctcatgtaatcaaaatgctctgaaaatcacattttaagcttaaacatttttactaatcctaaatggctcaattttgtgtctggttttcttcataccaccagatacagtttggcaagtgctcaaaggatgaattgataaaattaatacagaaacaactaacgaattctaaaaaatctaataaaatgattatatattataaaatagcaatgctcaaaatctggattgcatgtgctctcttataaaattatatagtgaaagcatatttatttgggtacagaatattcattcatttgaggcaaggtctcacctgtcgcccaggctagagtacagtggtgcgatcatagttcactgtaactttgaacttctgggctcaagtgatcctccagcctcagcctcctgagtacctaggactacaggataatttttaattttttttttggtagagatagaggtcttgctatgttgcccaggctggtcttgaactcctggcctcaagtgatcttctcgccttggcctcctaaagcactgggattacaagcgtgagccagactgtatccggccaaaattttcattcattcctttatttattttttgagacagggtctcactctgtcacccaggctggagggcagtagcatgatctcagctcactgcagccttgacctccaaggctcaaaaatcctcccacttcaacctcccaagtagctgggactacaagcatgagccaccatgccaagctcattttctatttttttgtggagccaggttatgctgtccaggctagtcctgaattcctaggctcaagtgatcctcctaccctggcctcccaaagtggtgggattacaggtaggagccactatgccagcccagaattttcacataattctaaaatccaaatgcttactcttgaaagtgattctaacaaaaaaaaaccaaaaagcaactattccttatgtgcaacacactgacagttttttttccctaacactgtaaaatttgaaaagatctgtagagtgaacatccatatacataccatctaaattgtaccactagtattttactctatgtcttttattgtagattcatctatccttccatccacccagttatttgatgctttttaaaattagatacagacatcatacatgtcacctctaaacacaacattaactagggttaaacatctgtttagtattttccttctaagagaaaatttatatgctatgaaagcatacaaatgaaccaccttatcagttttgacaaatgtatataacataaacccctgccaaaatacaaaacattaccatcatcacataacgtcccttcatgcccctttcccagttgatccctcctcacaatggcaataattgttgtgatttttttcaattatagattctggaaccccatataaatggaattttattggttctagaaccttacataaatggaaagaatgtacatactcttgagtaaggctttcactcagcataatattttaaagatttatccatgttcttgagtttatcaatattcctttttattgctcaatggtattcaccattgatgttgttttaacagtgacatatgaaatacttatagattctgattttgttccttaccttcatattgacatcggccccattgccaactagaagctctaaacacaatgctccatgtgttgatgcagcagcaaagtgcaaaggagtaaatcctttttcattcttttgattcacaatagcaccacagtctataagttcattcactacaacatcttgtccattatagcaggctacatgaagaggtgtatttccataggcatttggttcattcatctattagaagggaaaaaaatgcgaatgttaaagtagttttgctaattatcaatgttgtgagctattttagcaacctgtggttgcaatcaaattactaaagtgagaaacggagacaagataagtacagagataaggcttataattctaaagttggtttaaaataataaacccttgacaagcattttggtattacattgattttatacattcagggaatataattcacatacacaatgtctacttcatgacaaaactgaataatacaaaagaggtatttcagggaaacgtaaactaatgtatttttaaaggcgttctaggtaaaggatttactatagaattaattataatcataaaaaatgaacacaaactgaagattctgaggtatattcagtaacatgcacattttcatctttttcattttgcagtgacaaaggctaaccttagtaataaagtacagatcaagatttaaaaaaaaatgaacggcatgttctatttatttaattcattttttgccacaaacttgggctctaaatatcttccagtgtcatatgcaggtattttatcacaagtaaaaagagtatgctcaaaaatgagaaacaattcatgtaattaagggttttgcttttcttttttttgagacagggtctcattctgtcgcccagactggagttgagtggcacgatctcagctcaccgaaacctctgcctcctaggctcaagtgattctcctgcctcagcctcctgagtaactgggattacatgcacacaccactaccaactggctaatatttgtattttagtagagacggggtgtcaccatgttggccaggctggtcctgaactcttgacctcaaatgatccaccggcctcggcctcccaaagtgctgcgattacaggcgtgagaccctgtgcccagccttgtttttctatttctaataaataagggaatagtttatatgattagtgtgtagtaaagaatctgacctctcccaaagagaggtctgtcctttgcccctggcttcagggaggtaggtaatctaagatattcctgataaaagagtctctatttagagtgggagctttgggtcaccaggtatcatgtatttggagactgaaatcaaccacatggacaaccaatcaagccatataatggagccccaataaaaaccgaaaatgaagctcaggtgagcattccttgttggaaatacttcattcatactgtcacacactgatgccagggaagaacagtaatgtgtcctgactccgtgaagagtggacaagggaaattttgcctttagaatactcctgcactctatcctatgtgtctcttcctttggctgatctcagtttgtatcttgtccctgtaataaaccacaaccatgagtacaaagcttttaatgaattttgtgagactttctggtgaattatcaaacctgaaagtggttttgaaagccctctaaacttatagttggtcataagtaaagggtggccttgtgtggaaactctggaccctaatcttgtagttggccccaacataatgcagctttaattaacattttcttttctgggatcactggtaatagaaatcagaggaagaaaaaaagttaacacttaattttaatcaaagtaacctagattttttcacaagaaggtagaacacagacaaggaacagattctccctcagagcctccataaggaaccaaccttgctgaccccttgatttagaacttccatactctaaaactctgggaagttaaatttctattagccctccagtttgtggtaattctctacgaaactaaaaaaaaaacaaaaaacaaaaaaacaccacacaattgggggccagatgttactaaaaggctctaagtctggccacttattttgatgaacaaatagtcaccagagtttacaaatgtaactgactgtcaataaagtcagttttaaaaattgcaccagaatggacttcaaacagtaatcagaaacaaagttgcctcatttatctagatcaagggtcttttaagatattatttcactctgctgaaacagaggtacaggaattgagatttttgcaacgtcttcttgtgatcctcacactttcagtatttattagcttgcttcaggcaaagtgtttcacatggtccatcagttaagagcctatttagccctacagttctgtcatgtattctttgtccaaccaggctatcacctacttttcttagttttttgtagctgatctaaactgtatccctctagcagatccttatgctacatcttctaatttactgttttattaaagaaccaatgagttcttcaaaatgtgtgttttgaagaatcagtgactttgtcagaactctccctgaagtaagaataaatacgctgagtgggctgggtgtggtggctcatgcctgtaattccagcactttgggagaccaaggcaggagggtcacttgaggtcaagagttagacaccagcctgggtaacagcaagacctcatctctacaaaataaaaaaaattagcctgtagttctagctattcaggaggcttaggtggcaggatcacttgagcccaggagttcaaggttgcagtgagctgtgattgtgccactatactacagcctgggagacagagaccctgtttaaaaaaataataataaaataaataaataaacaagggagtaaagtacttatgtttaaaggatggcttgtgaaaagctacaggtattctaagttatctcaattcaggaatcaaatatgtccaaataaagcagcatccccttttaaccaaacagaattatatagtaaggaatacttacacttggtgggcaaaaaacctcttgttttcctgcctagctcttgccaatattctgtaatgcaaactgctacagtcattttaagagagtatgagactaggcaaagaagactaacaataacccagctatctaataatacaagtgtgtctgatctgctgattcccataaatgaaatggaactacagggcctggaacgtgatatagaagaaaaactggcaataaaacacctttgaagtgtattttacctcttaacatgctttgactatttacatgccttgatcataaatcagtgcactagatattatgtaaaggactataaatatccaattaaaacatgaaaacattgtataaaataatttcttaaacctgaaataacttgtcaataatgtaatagtaagtataaaagggttccataattttatactgttcaattaatatacctacatcaactccaagatctagaaggtacttgactacgctgatcattccactagaggctgctgcatgaagaggtgtataagactttttatccttgcatgtcacttcagctccatgcgacacaagcaatttcactacttcaatgtgacctaaaaatgtgtttttgaagaaaaaaatagagatgagcatatgaaaactattaaatataatcccaaatatctttaagcaaatttaaaaaatgcaaaatagatgatgcatgacaagtcatcaatgaatcatgttaacttgagagaggacagaaggaaaattttaagactttaggggtgggcataatggctcatgcctataatctcagcactttgggaggctgaagtgggaggatcacttgagcccaggaatttgagaccagcctaggcaacacagtgagaccctgtctccaccaaaaataaaaaaaaattagctgggtatggtggcatgcacctgtagtctcagttacttgggaggctgagacagaagaattacttgagcctgggaggttaaggctgcagtgagctgtgatcatgccactgcactccagggtgggcaatggagcgaggccttatctcgaaacaaaacaagacaaaaaaatagaattcaggataattttggtaagtgttggcagagacaattagtaattaaaaagaatgttggccctctgtatacactagttccatatctgcagattcaaccaactgcagactgaaaatatttgaaaacataaaaacagttaaaaaaattaaaaatgcagtacaacaactatttacattgtattaggtattataagtaatctagagatgaattaaagaacaggttatacgtacatactatggcattttatataaggaacttgagtatcttctgattttggtatccaaaggagtctgaaactaataccctaaggataacaagggacaactataattcctttgattatgttattcagtgataaccctgcaatctatcatcttccttttgcctagatcttgtttttggtctaaggttagtttaataccttcataaattctaaagttagcttttcatttctaatgctggcataccatattgtatgtactttgctttattgtgctttgcaaatattgcatcttgtttcttaaaaattgaaagtttgtggcaacccggtgtcaagcaagtctattggcatcattttttccatcagcatgtgttcatttcatgtgtctgtgtcatgttttggttattcttgccaatatttcaaactttttcaatgttattttatctgttttggtgatctgtgatcactgatctttgacattcctactgtaattgttttggggcatcacaaactgcactcatataaagtggtgaactgatcaggcacggtggctcatgcctgtaatcccaacaatttgtgaggctgaggcaggcagatcacctgaggtcagaagtcgagaccagcctggccaaaatagtgaaaccctgtctccactaaaaatacaaaaattagctgggcatgctggcacacacctgtagttccagctactcgggaggctgaggcccgaaaatcacttgatccctggaagtggaggttgcagtgagccaaaatcatgtcactgcactccagcctggatgacagagtgaaactctgtctccaaaaaagtggttaacttaataaatgttgtatattccaactactccattcccccatctatctcctcttcagaccttcctcttcactcagacacaacagtattaaaattaggccaaataataaccctacagcagcccctaagtgttcaagtgaaagacagttgcatacctctcactttaaatcaaaagctagaaatgactaagcttagtgagaaaggcatgttgaaacgtgagacaggctgaaagctaggcctcctgtgacaaagttaccaagtagtgaatgcaaaagaaaaattctccaagaaaattaaatgtgctaccagtgaatggactaatgataagaaagataagtggccttactgatgatacagagaaagtactagtggtctggatagacgaccaaaacagctacaaaattcgcttatgccaaagcctaatcgagagcaaggcctcaactttcttcaattctatgaaggctgagaaaggttaggaagctatagaggaaaagtttaatccagcaaaggttgattcatgaggtttaacgaaaaaagatgtccctgtaacaaaagtgcaatgtgaagcagcaagtgctgatgtattaatagaagctgtaaaaagttatctaaaagatataagattattaatgaaggtggctacattaaacagcagattttcaatgcagatgaaacggccttctattggaagatgccatcaaggactttcgttgctagagagaaatctatgcttgccatcaaaacttcaaaggacaggctgactctcttgttagaggctaacgcagctaatgactttaagtcaatgctcatttaccattctgaaaattctacagcccacatgaattatgctaaatccactttgcctatgctctaaaatggaacaaagcctggatgacaacacatctgtttataacacggtttactgaatattttaagcccactgttgagacatactgctcagaaaaaagaagattcctttcaaaatattactgcttattcacaatgtacttggccacccaagagctcttacagacaaggagattactgttgttttcgtgcctgctaacacaatagtcactctgttgtccctgaatcaagagtaatttcaactttcaaagtcttattatttaagaaataacatttgaagtggatatagctgccataaatagtgattcctcaaagtaaattgaaaaccttctggaaaggattcatcattctagatgccattaagaacatacctggccaggtgcggtgcctcacgcctgtaatcccagcactttgggaggccaatcacctgaggtcagcagttcgagaccagcctggccaacatggtgaaaccctgtctctactaaaagtacaaaaattagccaggtgtggtggcgggtgcctgtaatcccagctacttgggaggctgaggcaggagaatcacttgaacacaggaggcagaggctgcagtgagccaagatcacaccactgcactccagcctgggcaacaaagcgaaactctgtcaaaaaaaaaaaaaaaaaaaaaaaaaagaaagaaagaaagaacatttctgattcatgggaggaggtcaaagtattattattaacaggagtttggaagaagttgattccaaccctcatggatgactgagggattcaagacttcagcgaaggaaataactacagatgtggtagaaatagcaagagaactagaataagaagtggagtctgaagatgtgcctgaattgctataatctcatgataaaatgtgaacagatgaggggttgcttcttatggatgagtaaagacagtggttttgtgagatggaatctactcccaaagatgctgtgaatgttgttgaaatgacaacaaagcttttagagaaatgactccaattttgaaggaaattctactgtgggtaaaatgctatcaaacagcttcacatgctacagagaaatcttttgtgaagggaagagtccatcgatgcagcacatctttgtctcatttcaaggaattgccacagccatccaaaccttcagcaaccattcacattgaggcaaaactctccattatcagagattgtgacttgctaaaggctcatacgatagttagcatttttttttagcaataacatattttttaattaagaacactgaaaattaataaaaaagaaaaaacaaagacatgtatattgttttagatgtattgctattgcacacttaatagactatagtatagcataaacatattttgtaattaattaattatttttagaaacggggtcttgctctgtcaccctggctgaaatgcagtggtgtgatcaatctcactgtaacctcaaactcctagattcaggtgatcctcccacctcagccttctgagtagctaggactacagatgcatgccaccacactgggctaatctttaaatttttttgtagagacagggtcttgctctgttgcccaggctgatcttgaactcctggcctgaagcagtcctcacacgttgggctcccaagatgttaggattacaggtgtgagccactgcagggagactaaacatatcttttatatgcactgggaaaccaaaaaatctttgtgatttgcctattgctgtatttactctgttgtggtagtttagcaccaaactcacaatctctctgatctctgccttactggaatcgtttcaatctgggggtttcttgggcttgtttcttcagaatgttagctctttagaacatgcagccaaaaaactctttttccttataatttccaccagatcttaaccaacttagtttactcaccattgtaaccatgaggaaagggttggttatactgtgtgatggttaacaatcaactcccaaatctcagtggcttaaacaatcaatgtttttatttctctctcaaccataacaggttggcaagagggctctgctcagttactcaaggacccaggctcatgtaactgacatcatcttgaatgtggctggtcactgtgccagaaagggaaacagactgcagagtttcccatcagtaattaaatgctccagcccagactgatgttgctttcatccattagccaaaactagtcctaggccccactcaactacatagaaaggccaggaagggggccatgtatctggaaggtgagaggaccactattctcctttcataacttgtcactttttgtcagattagattatacagtgttttctccttctcccacaatccttcccacctctgtgtctttgttcatgtaacaccttctttatgtggaacgttctgcttggatgtctcctcccaatcattgctattatactagtccttgaagaaacatgtcagatccaacctttcctgaccaacccaatcaactctcttccctagaagccctataagccttgtgatgtttcgtaaacggaatcattaattactaactctttaattactttttgtgcatgaatccccaaatatatactttcagaaggctgttctacttcttgatatgttccacaaggccaagagcagcatagaaaacaagcatccaaaatatattagttacattgaagaaattgctcgtgatgtcattttaaaaatcccttcatagataatgagtctataaaaagttaataaatgaggctttcaaacagaggcacccctccctcaaaaaaattaagccaagatactgcaagacgcataaagaaccaggcagattcagttgtttatatataaattatcaattaaagtagatatttacagcctctttccccccattttaatatgaaaaagaaatatctactattatgtttctagaaaagaaataatgcaatgaggtgttaaggtaatttttaaaaatcaattaaaaaatttttgagacggttttggctctgtcaccttggctggaatgcagtggtgcgatcacagctcactgcagcctcgacctcctgggctcaagtgaggtgtgtgccaccacacccagctaatattaattttcttttttttgtagagagagggtctcactatgttgcccaggctggtcttcaactcctgggctcaaggatcttcccacctcagcctcccaagttgttgggattacaggcataagtgaccatgcccagcccatggtaaaaaatatttattcagtaccttctgtgtcaaagtcatcacaataaagtaatttgaagctaaacttggctgaatatttctaaaagtactgaaagcaacaggaaagatgaatgtgtaaagggaccttgacaaaggttgatggcaggagcaagcacaaggtgggaagaagaaaatgatcaattcatttggagatgaggtggggcgctagggaacaatgacaaataattcaatagcataagtataagaggtagggcctaaaaggaaattaacggagcctcaaccaggaaatggaaagccagggctaataaggaaaactgggataaataaattacaagactacacataatccccaatgtctcttacactaacattgatgaattctctgaatataacctagaggtgacaatgcttgtactttaggtttgtctgtaagagaggtgaccagtcaatagcttcttactttcacatatttaactctttaatcctgcatacctagaatggctgaacagttttagaagctatatgtcgatattcatcttattctgtgcttcagggaaggaagagacagaaaaaggataattataaatctctgcctagttatgctcataaattaaatgggcagtgctatatggtactatggtttaaatgtgtcctccgaagttcatatgttggaagtgtaatccccaaggcaacagtgttaagaggtgggaactttaagaggtgattaggcaataagggctctgtcctcacgaacatatcaatgctatcttgggatcgagctccttaaaaaagatgagtttgactccccacaatgtggtgcttcaagagggccctcactagatgctagtgccttgatcctggacttcccagcctacagaactgtaaggaaataaaatttctgttctttataaattacccagtctatgacatttaattttagtagcacaaaatagactaaaacttgtggtgaggtccaggaaacacagaatatctttttcaacctcaactgagatgcctaaaaagtgacacttagcgggtgagaaacaacagagccattctggcccccttgaaatacacacattcaactattctgggagctcaactacaggcaacctgcaaaatccccctggccttcagttgtatgaaaacagttgtttagtcaagcttaattcttagtaggtaaaaacactgatgcactctgcttaccatgtaagcctcttaacgtaagatgtacagttttacatcacataacctggttgttcctgtcttgaagagtaagccacaccagaatattcagaaagaccaagatgaaaaactacaggctgtgagaaagggaccttaagatgcaatacggaacttgcttctggctattaccttcaattaacacaagaaaatggcccagtacataactagcggcacatatctttggtgtaaaccaccatacaccaagctttcagctttaaaaatagggacatttgcagaagttcaagaccagcctggtcaacatggtgaaacctcatctctactaaatatacaaaaattagctgggcgtggtggcaggcgcctgtagtcccagctactcgggaggcggaggcagaagaatcgcttgaacctgggaggcggaggttgcagtgagccgagatcacgccattgcactccagcctggacaacaagggtgaaactgtctcaaaaaaaaaaaaaaaaaaaaaaaaaagggggggggggtgtgtggggaggggacatttgaaaaggatgttacattttttttttaatcttcctttacactcacactgaaggtcagagctgcaatgcaatatggattctcgggcttctgcccagtgcatggctacatggtctctacagtttcctagtcatgcaagtgtgatgggagaaaggctgtactttagctgcactcagttctcagtgccactcccggagagagcaggaccctgtttagggtgatgaccccatagtgggtagaaactctgaagtacagagggactctggatgttgcccgcttagaaaggaaagagtttgccccaatggaggtcaaaagcatcactccacagtctgaaaggggagggggagaatgcacagtcttctatcacccagggaattaaattaaattcactgcagaacacagttgggatgtgttcactgaaagcagaggcatacatacacagggtggcagaaccgctgctggccaaggtgaaggggccagagctgtatgtggagaggtggaagatgcttcatgagctaaatcccaatcccaggggagctggtaagaccatggtcaactcagtgttcatgacagacacacttaaccttatctgctatttggtgagagcaggacacgcaaaagtgtgttgtgaggtatgggggagaacatatggtattggtccctgcagtcgcggcagtcaacagatccttcagcaaagggacatcaactactattacctcatactatgccacagttaacaaccctagatcaagtttggcatatacttcattctgaaacaaatgtttcctctcatgcctttgacagaagagaggcattggattctcgatgaagccaggaaaattctgttgaaaacgtctggaggcacgttttttcccatttgaggggaagaaagtttatttttacaaacaagcccaaatccttgtaacagatatgtggaaagtattagaagaaaaaggagatggctgctttaagacatctccagaccaggcatagtggctcacacctgtaatcccagcactttgggaggcagaggcagaccgatcacctgaagtcaggagtttgagaccagcctggacaacatggtgaaaccgtgtctctactaaaaatacaaaaaagttagccaggtgtggtggcgggtgcctgtaatcccagctactcaggaggctgaggcatgagaatcgcttgaacctgggaggtggacttgagtgagctgagatcgtgccgctgcactccagcctgggtgacagagcaagactctgtctcaaacaaaaacaaaaacaaaaacacatctccagtattacatgtttgctaactacagattacttcaggttcttgctcaccatggacctctgaaatactcttacgaactactgaagaaccttttcgaaggagaaatactgtcatatggggataagcaagagtgggaaaatcagcatgctcactttggttgtggtgagctgatctgggattgccttctgaggcttattgaaaagggaacgaaaaatgacatattaccgtctattcccaacttcatcatttatctgcttaattctaactatgtttttcttttctgtggacatactgttagaaatattgaaggcactttaatattttcttcaaatatcatttcttaaaattaatcatgctttatgtgactattcttcggtgataatatttcatctattcaattgatatcatttctcaaaatgtagtaattttctgatacaaaggagagagataaggtaaggtctctgatgcatgaatgctgttgcttttgtaaaaaatcactgttgacaccttattttaaatgttttattggtaatgagagtgggttttgtacatcacaatcttcaatttagtatacctatgtagaatttttttttcagagtaactatactggaattgaataaagattttcaaaacttttcttaaaaaagaaaaaggattctactgcttttggttgttttcattataggcataggatttccctgggccttgtgggtatctataactggtttgaaatatacagacatgttatgtatagacttatttatctagaaagagtgtattataactggtttgtatctattttacatattatacagttgaccctggaataacaaaagtttgaactgtgtgggtccacttatatatggatttttttctaccacatgtggttcaaaaatatagtattcaggggatgtgaaacgctcatacacggagagccaactttttgtacataggggttccccatggctgactatgggacttccatatgcaaggatttgggtataagcaggtggtcctggaaccaatcctccacatatatgagggatggactatatagttcttgagttaatattcctccattgaatcttctgttaatcttttatttttaaatgagagtcaagaaaagacaaaaccaagaacagaaagtaatgaggataggctatggctcttagaaaagtggttaactagatgtctttgtaatcaggtaatgtgactggtaaatcagggaatgatacaaatattacacagaaaacatgtcagttcatatgtgctttttcccacccaggagttaaaatagcagaagcacaggattataacctctggcaggaagaaaaaaagccctgagctctatggctgcaaagtgagttctttcagctgttttaagaaccttgaaaaatgaatgtctacaaccatggcttcttaccagaggcacaaccccagccttataggactttaaggatttatggcaaggtgtactttctctatacttagagatctaccttcctcggcagttttagcatccagaagcgagcatttctattctgctgtttttgtgcatttaaaaatatcctgtaataggctgatttgtctccccggctctgcaagaaccaattaatgtttctgttagtgctgtggtcacacggttgcataggttttgggtggtctaccccaggcctattattcccatgagctctattagttttagagtacaattttgcagactgtaagatttttcaagaacatatatattatgttacagcaaaaaagtctgtattccaagccccagtttctttctataaatttactattatagaaatcaaacatggtaatacacatttaacccactggttggcccaaaataataggcttcttaatgcatctttgttacttttaccttatattctcatacaaacaaaaatgggtataagaatgggctttagtaaacatcaatcctaaattatgtattccaggcctgtgtctgggacatctctttttttaagggtaaatggaattaatttcaaacagcttttagatgaactggacccagtgtactccaaacctcccccattaccagggttgttctacctgggcatcaaactcagatactgtgtagcttttcagtacccttaaagacaaatgctatacaaacagcaagaacttgaaatgtacaacttttctaaatatataatatcaaaaactaaatttaaaaagtacatacccatatatgctgcccaatggatagcacgcctatctttcttgtcaaaagcattaatattggcacctctagacaagagtagtttgaccatctggaatagaagtaaacacagtgtcatcaaaattgtgaagcacaattgtctatgaatgtacatttctgacagttacttatctcaacttctctggcactaaatttctgcagttgctgaacagaaggagctagactaaatactgaaggtcatttaacataacaggacaaaacatgaaaaaaaggttaactgtgggtgctactgaagtcaggcatcagtacctttttaggatgccactttgtgccttggtattttatgaactaagtacaaatctggaaagtctaagactgaaatatttaataagaggttttgttcctattcatagtccaaaatgttaaaagtgcattctcattctagaaatgtcttaaacttaattcaaacacaaacatagtgcctacagtataattatacctgaaggtcagtcactgcatagtctgcttacctcacaatgtaccaaaaataataattgcaactaaccatatttacaataatttctccactggaaggctaccgcagatctcaaatagggatacatctgtaaccttaactgcagtagaggcaaggattctttacactggaaaatcagagaagtacagtagtctccccttatctgcagttccactttctgcattcaattacctgctgtcaaccatagtctgaaaacaggtgactacactacagttacagtgggatattttgagagatagactacattcatgtaacttgtattaaaattgttccatattattatctcttactgtgccttaattataaattaaattttatcatcggtatgtataggaaaaaaacacagtatctatagggtttggtactatccaatgtttcaggcatccatagggggtccaggaacatatcctctgtagataagtgggaactactttgaaaaagacatggcagccactagctcccagccacagaatcttgggaatgttactttacctataagttcctacccctgcaacaaaaatgaaagactagacaagttggcttcaaaggttcttctgttaccttctctaaatctttggtgtacacataaaccccaatctttgctatgacacctagcacagacaacgtttgttgtgtaagataactaaatagcaattttcttaaattgttttgatggttctgtcactaaagtattatcttgactaaatgttaataaactactaaaaagcatgttttctaaattctgccttcctttgctatttacttctggaagaacaataacatatctctgtcttcacatatttttcctgccacaataatagaacatacttttcctgttgtgttaagagttggtattgttttccttggtcaccacaggttaactgtgcacaagtagtatctactacatacatttctaaatttgagaaagttataaaaggaggcaaaattagacaaaaatgagaaagataaatagttctgtatgcctttactatgcaaaaatgcaagttctttaataagtggggggtggacaggaggagagaaaaataatggtctaattgaatgccacctacctcaccatgtccactgaaagctgcatgatgtaatgcagtcctccctgctcgatcagatacgtttacattactcagaagaggtaccaaagcttcagcacactttacagctttattagcagcagctatatgtaaaggggtttgccaatttttgtctcgagcattaacatctgcagaatgcttcaaaagtacctgaactgcttcctaaaacatatgaaaagttataaaagacaaatgagttaagagtttgagaaattatttctatatatagtgtgcgtgtgtgtgtataaatatgtatctacatatgaagaaaataaaaaagctctcatagaactcactataaacaagtaggaatttacccaaggaaagaaaatattttgaatgtaaagcgatactgagagtactcagagccatataagatgcatcaagatcaaacattccctttccctaccctaccattaaatgcataaacattcctatcaaaatgtgcaagagagcaatcatagctcaccgtaacttcaaattccttggcttaagtgatcctcccacctttgcttcctgagtagctaggactacaggtgcatgccaccacccctggctaattttttagttattttgtagagacaaggtcttgctatgttgcccaggctggtctcacactcctggcctcaagtgatcctccttccttggcctcctgaagtgttggggttacaaacatgagccagtcatagagccacacctggctctttgaacaattttaagcaatagattttttacactgcatatataaaaattaaaaacatactatttctcaatgtattatacatgctatatttgacaaaatgaaaaatcactaggatcaatttcattaaaaaaaaaaaaaagacacaacatagacaaggttctttttgcagtgctgcttagagagaaagttaaggcaatttaagagtctactgtccaagggatttatctcccagaagcgcatggaaaacatcacaacactacctctataaattggactcatggcaggattccaaggaattcagtatgccatcaacattaagcaatataatcagaactaaactcaacaaaatttttctttcagtgataatcctaatttttggtaaattatcggggaacctgcccccaataattcaaagtgagtccttttctattttccctaagtgtcggctggtctgagaaataaagggaaagagtacaaaagagagaaattttaaagctgggtgtctggggagacatcacatgcccaagccgcaaaaccagcaagtttttattagtgattttcaaaaggggagggagtgtacgaatagggtatgagtcacagagatcacatgcttcacaaggtaataaaatattacaaggcaaatggaggcagggcgagatcacaggaccaggtgaaattaacattgctaatgaagttttgggcacacattgtcattgataacatcttatcaggagacaggggccgggcacagtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacagagcaggtcaaaactcccgtgctgatcaggagacagagtttgtgagcagacaactggtctgaccaaaatttatgaggtgggaatttcctcttcctaataggcctgggagcgctatgggagactggggcttatttcatcccttatctgcaagtgtaaaaagacagacgttcccagagcagccattttagagacctccccctaggaatgcattctctttctcagggatgttccttgctgagaaaaagaattcagcgatatttctcctatttgcttttgaaagaagataaatatggctctgttccgcccggctctcaggcagcctgacctaatggttatctcccttgttccctaaacatcgctgttatcctgttctttttttaaggtgcccggatttcatatcgttcaaacaatttgtgcagttaactcaatcatcacagggtcctgaggtgatgtacatcctcagcttacaaagatgatgggattaagagattaaagtaaagacaggcataggaaatcacaagaataatgactggggaagtgatgtgtccatgaaatcttcaccatttatgttcagagactgcagtaaagacaggcataagaaatcataaaagtattaatttggggaactaataaatgtccatgaaatcttcacagtttatgttcttctgccatggcttcagccagtccctccacttggggtccctgacttcccgcaacagtaaatgaatgccaaactacatatgaaaatgaaaacgaccaaaaccgaaagagatctgggttctcatgtcaattctattatttacaaggcatactattcaagtcctataaaactaaccctaaatgttcttatctgtaaaggagatgggggtgggggaaataacatctgcctaccactcttttcaagtatgctataaagcacaataaactaatgtacatgaaaagtgttagaaagtgaaaatagctataaatatacagagcatcaaggaagactgaacaaaatgctattagccatgaatcacccataccattttaggcctctgaaataaaaagtagtcagaacagtttgaaacatgggaaatagcaccagtacttaacagggatggcaaaagactgaagaaatgcccagtcatctatcgaattgctaaggaagtcagccagctaatcaaagatatatggaggcctatcactccacaattccacaacagtgatttatccaaaagatttaaaaaatccatccaagaatgctcatagcagttttattcctaaccaccaaaaaccagaaatgcaaatgtccatcaacagaaaaatggataaacaaacagtatatctgtactattactcagcaatgaaaatgaaccaataatgcatgaaacatggataaatctcaaaaacgttgaacaaaagaagtcgtgacacaagaatacatattgtatgattccatttttataaagttctagaatacggaaattatgctaagagaaatcagaacagtggttgcctctggggacagggaagactgaaaacggacatgagggaacttgctggggtaacagaaatcttctatatcttgactgggataaaggttacacaggtgtatacatttggcaaaacttaagggtgtacactaaaaaattcatgcattttaattgtaagttatatttcaatttaaaaaggaatatggaaagaatacatatatgaatactcacaaaaattatggaaaacaaggtataaacactatcaagattcctgatcctcacctctgagaacagtacattgtgacttgggggatctaaaactaacactatattgggaaatgttagtaggtatgttagtggatataataaataatttaaaataaaatgaacaatttgtaattggataaactgggcaaacacagaatactagagatgtcagccttgccttatccactcccattttggaattcataacacaaacattaaagcttctggaaagtttgggaaatacttatgttccattagtaaaaacaggaaaatcaattctacttttttgtttcactaaaaagcaagaacaaatctggttcacagtaggtaagcgtaggtaagtgggcacctaaataagacaataaacatagcaattaagacactagagtatcaagacagatcaaggtgtgaaccctgaatccattatttcctactcagagtaatacatgtcagatcacaggcctggtgcggtggctcacttctgtaatcccagcactttgggaggccgaggcaggtggatcacgaggtcaggagatcaagaccatcctggctaacagggtgaaaccccgtctctactaaatatacaaaaattagccaggtgggggggcgggcgcctgtagtcccagctacctgggaggctgaggcaggagaatggcatgaacctgggaggcggagcttgcagtgagccgagatcgcgccattgcactccagcttgggcgacagagcgagactccatctcaaaaaaaaaaaacaaaaaacaaaaaacgtgtcagatcacaatagcagtgatctttgaaaattcagagaaaactgaagaaaatccctaaaggttggagacattaaaaaagaagaggtgaatttctagaactacaaatcaaagagcctgtcataccctaggataattctacatcatattatcagtgtatcatcataagcacacggaaaataatgtggggataactaacggcacagatgattttattaacaaaaaacattattatagtaatctaaattctaaattttcagttattagagggaatgtgtaagaaatgctgctggtgtgtcttgattttttttaaaagctaagtaaacattccatgacattaattcaaatgagattatgaaatatgggataatgactgaaggttaaacaactgtactcagagagtatttattattaccatggggtcagtatagaagaggctccacagtaccagttttcccctttggttctatccttttttttttttttttttttttttttttttttttttttttagcaattcttaccattgatttgaaggaaagcacaggaaaaacaagggcttaacatatttgcaggtactgctgccatctcagctcactgcagcctccctgcctgattctcctgcctcagcctgccgagtgcctgcgattgcaggcgcgcgccaccacgcctgactggttttcgtatttttttggtggagacggggtttcgctgtgttggccgggctggtctccagctcctaactgcgagtgatccgccagcctcggcctcccgaggtgccgggattgcagacggagtctggttcactcagtgctcaatggtgcccaggctggagtgcagtggcgtgatctcggctcgctacaacctccacctcccagccacctgccttggcctcccaaagtgccaagattacagcctctgcccggccgccaccccgtctgggaagtgaggagcgtctctgcctggccgcccatcgtctgggacgtgaggagcccctctgcctggctacccagtctggaaagtgaggagcgtctctgcccggccgccatcccatctaggaagtgaggagcgcctcttcccggctgccatcccatctaggaagtgaggagcttctctgctcggccgcccatcgtctgagatgtggggagcgcctctgccccgccgccccgtctgggatgtgagaagcgcctctacctggccgcgaccccgtctgggaggtgaggagcgtctctgcccagccgccccgtctgagaagtgaggagaccctccgcctggcaaccgccccatatgagaagtgaggagcccctccgcccggcagccaccccgtctgggaagtgaggagcatctctgcccagcagccaccccatccgggagggaggtgggggtcagccccctgccaggccagccgccccgtccgggagggaggtggggggatcagccccctgcccatgccagcctgcccgtccgggagggaggtgggggtgtgagcttcctgcccggccagccgccccgtccgggagggaggtgagggggtcagccccccgcccggccagccacccggtccgggaggtgaggggcgcctctgcccggccgcccctactgggaagtgaggagcccctctgcccagccaccaccccgtctgggaggtgtacccaacagctcattgagaacgggccatgatgacaatggtggttttgtggaatagaaaggggggaaaggcggggaaaggattgagaaatcggatggttgccatgtctgtgtagaaagaggtagacatgggagacttttcattttgttctgtactaagaaaaattcttctgccttgtgatcctgttgatcggtgaccctacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactctgcctaggaaaaccagagacctttgttcacttgtttatctgctgaccctccctccactattgtcctatgaccctgccaaatccccctctgtgagaaacacccaagaatgatcaataaaaaacaaacaaacaaacaaacaaaaaaaaacaaaacatatttgcaaataaacacaaagcttggagagaccacacaatatctcatgtgataatggaatttaaactcagttatcttgacagacctaaaatgtaattcctgattaggttaaaatataagtcgtatgctctccagcagtgcagtgtggctttttaacacacacacacacacacacacacacacacacacacacacacacacacgcacaccaaaaacaaaacccaactcctaatactcggatatccatttattcagaaaaatatgcagtacttacacagagctgaactatatgctactcttaaagaatgacagtcataaatcatagtagtagagacagattgagatagccagctagtaggaggtggtgtggaaactatgtcactgaaggagagttggggagtctaggaatatttaacctgaagcagtctttcttaacctagtttcagtgaggtaattaagcactaaggtagtacggtatgtgctaagttaagttctcttctatgcatctatcactgtgctagctattctgtccttaggagaatttagaaaacagtcactccaatcagcttgcacaggatttaattctcccatggtatctcaaaaatataaaccaaaagccacctacaggtgaaaaacccatctttctgtggccatagctatattttctgttaaatgtaataagtatagctacttttgctctcaggacttaatgaaaataagtaacgatggtgtaagtgatactcttgacactaatgactaggttttctagcagttttactacttaggagaccttcttttcaaaagaaaaatgatactcagtgtttacagaagttatatctttttggaatggccacattttatagctgtttctcataatcctgcaaaagagtatcaatactacatagccttgtaatttttagttatctttttcttttttttttagatagagtttcacttttgtcacccaggctggagcgcaatggcgcgatcttggctcactgccacgtctgcctcccaggttcaagcgatcctcctcagcctccagagtagctgaaactacaggcgggcaccaccaaacctggctttttttttttttttgtacttttcatagagatggggtttcaccatgttggccaggctggtcttgaactcctgacctcaggtgatctgcccacctcagcctcccaaactgctgggattccaggcgtgagccaccgcgcctggccaatacagtattttctttatccagtcattgactgatgcgtatttgggctggttccatatttttacaattgcaaattgtgctgctataaacatgtgtgtaccagtatctttttcttataatgacctctttttctctggattgatatctaagtggtgggattgctggatcaaatggtagatttagttctttaaggaatttccacactgttttccataatggttgtactagtttacattcccaccgacagtgtaaaagtgttcccttttcattgcatccacaccaacatctattattttttcatttttttgactatggccattcttgcaggagtaaagtggtatcgctttgtggttttgatttacatttccctgataattagtgatgttatttttccatgtttgttggccctctgtacatcttcttttgacaattgtctattcatgtccttagcccactttttgatgggattgtttttttcttgctgatttgtttgagttccttgtagattctggatattactcctttgttaggtgtatagattgcaaagattttctcctactctgtgagttgttaatgctgctgattgttttcttttgctgtgcagaagcttttcagtttaattaagtcccatctattttttgcttttggattcttggtcatgacgtctttgcctaaaccaatgtctagaagggttttttctgatgttatcttctagaatctctatggtttcaggtcttagatttaagtctttgatccaccttgagttgatttttgtataaggtgagagatgatgatacagtttccttcttctaatgtggcttgccaattatcccagcctcatttgttgaacagggtgtcctttccccactgtttttgtttgctttgtcaaagatcagttggctgtaagtatttggccttatttctgggttctatttctgttccattgctctatatatctatttttataccagtaccatgctgttttggtgactatggccttatagcatagtttgaagtcaggtaatgtgatgcctccagatttggtctttttgcttagtcttgctttggctatgcaggctcctttttggttccatatgaatttcagaattttttttttctaattctgtgaagaatgatggtggtattttgatgagaaatgcactgaatttgtagattgcttttggcagcatggtcatttttgcaccattgattctacccatccatgagcatgggatatgtttctatttgtgttgtctatgacttttttcagccctgttttgtagttttccttgtaggggtctttcacctccttggttaggtatactcctagctattttactgtttttctgcagccattgtgaaagggaatgagttcttgatttgatgctcaacttggtcgccattagtgtatagcagaactactgatttgtgtacattaattttgtatcctgaaactttgctaaattcatttaccagttctaggaggttttggaatgagtctttagggttttctaggtatgcgatcatatcatcagcaaacagtgacagtttgacttcctctttactgatttggatgccctttatttcattctcttgtctgatgtctctggctaggacttccagtactattttgaatagaagtggtgaaagtaggcatccctgtcttgttctggttctcagggggaatgctttaaacttttccccattcagtaaaatgctggatgcgagtttgtcatagacagcttctattaccttaagatatgtcccttctatgctgatgttgctgacagttttaatcataaaaggatgctggattttgtcaaatgctttttctgcatctattgggatgatcatgtgatatttgtttttaattctgtttatgtggtgtatcacatttactgacttaggtatgttaataacaccatccatgcacccctggtatgaaacccacctgatcatggtggattatctttttgatatgctgttggatttggtttgccagtattttgttgaggacttatgcatctatgctcatcagggatattggtctgtggttttgttacgtccttccctggttttggtattagggtgacactggcttcatagaatgatttaggaaggattgcctcttttggaaaagtatcaataggactggtaccaattcttcctcaaatgtttgatagaattcagctgtgaatctatccagtcctggactttttatttgctggcaatttttaaaattatcatttcaatcttgctgcttgttaatggtctgttcagagattctataccttcctagtttaatctaggagggttggatatttccaggagtttatccatctcctctaggttttctagtttatgtgcgtaaaggtgttcacattagccttggataatcttttgtatttctgtagtatcatttgtaatatctcccatttcatttctaattgagcttatttggatcttgtctcttcttggttaatcttgctaatggtctatcagtgttatttaccttttcaaagcagcagctttttgtttcatttatctttcctttttttttttttggtttcaatttcatttagttctgctctgatcttcattatttcttttcttctgctgggtttgggtttgggtggttcttgtttctccagttctgtgaggtatggccttagattgtctatttgtgctctttcagactttttgatataggcatttaatgctatgaactttccacttagcactacttttgctgtatcccagaggttttgataggttgtgccactattattgttcagttcaaagaatttttcaatttctatcttgacttccttgttgacccaacgatcactcaggagcaggttatttaatttccatatttgcatggttttgtggcttccttttggagttcatttccaattttattccactgtggtctgagagagtacttgatataatttaggttttcttaaatttactgagacttgttgtgtggcctatcatatggtctattttggagaacatttcatgtgctgatgaatagaatgcatattctgcagttgtttggtagactgttctgtaaatatctgtcaagtccatttgttgtagggcatagtttaggtccattgtttctttgttgactttctgttttgatgatctgtctagtgctgttaatggagtattaaagtcccccactattattgtgttgctctctcatttcttaggtctagtagtcactgttttataaatttgggagctccagtgttaggagcatacatatttagaattgtgacattttcctgttggactagtccttttatcattatataatgtccctctttgttttttcctaactgctgttgctttaaggtctgttttgtctgatataaaaatagtgatccctgctcacatttggtgtccatttgcatggagtatctttttctacccctttacttaagtttctgtgagtccttactcttaggtgagtctactgaagacagcagaaacttggttggtgaattcttatccattcttccattctgtatcctttaagtagagcatttaggccatttacattcaatgttagtattgagatgtgaggtactattctattcctcatgctatttgttgcctgaatacctttttttaaaaatcatattattgttacataggtcttgtaagatttacggtttaaggaggttctattttggagtatttcaagaatttctttcaaggtttagagctccttttagcagttcttgtagcgctggcttggtagtggtgaattctctcagaatttttgtctggaaaagactgtataccctccttcattcatgaagcttagtttcactgggtacaaaatttttggcagataatcgttttgtttaaggaggctaaaaatagaaccccaatcccttctagctttgtagggcttcgctgagaaatctgctgttaatctgataggtgttcctttataggttacctgatgcttttgcctcacagctctgaagattctttcctgcatcttgactttagataacttgatgactatgtacctaggtgataatctttctgtgatgaatttgccaggtgttctttgagcttcttgtatttggatgtccagatctcttgcaaggctgggaaagtttccctcaattattctctcaaatatagtttccaaacttttagagttctcttcttcctcaggaacaccaactattctcagctttggaaaattaacatagtcccaaacttcttggagacttcgttcatttaaaaaaaaattttttttctttgtctttgatggattgggttaattcaaaagccttgtcttcaagcgctaaagttcttctgtttgtttgattgtattgctgagactttccagtgcattttgcatgtctctaagtgtgaccttgatttctagaagttgtgactgtttttacctatttcactaaagaattttcctttcatattctatattatgtttttgttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtctcgatctcctgacctcatgatccacccgcctcggcctcccaaagtgctgggattacaggcgtgagccaccgcgcccggcctatgtttttaatttaagttggacttcacttttctctggtgtctccttaattagcttaataatcaatcttctgacttcttttcctggcaattcatagacttcatcttggtttgcatccattgctggtgagctggtatattttgggggtgttaaataaccttgttttgtcatattaccagaattgtttttctggttctttctcatttgggtaggctatgtcagagggaagatctgggattcaaggactactgtttaaattattttgtcccactgggtgttcccttgatgtggtgttctcccacttcccctaggaatgggtattcctgagagccaaactgtagtgattgtttttgctcttctgggtctagtaacccagtggagctactaggctccgggatggtactggggaatgtctgtaaagagtcctgtgatgtgatctgtcttcaggtccttcagctgtggatactagcacctgctccagtggaggtagcaggggagtgaagcggactctgagggttcttggttgtgtttctgtttagtcatctgccttgtaatttttagactgaagagtagaattaagaaacttactaggattatttgctttctaacctacaacttgcccttaaattcaggctgagcacatagtttttaaaaattaggaattaagtctctggcagaatttgctgtcttcctttaatgttaatttttctttagtaatttttggtctgttttacaacttctgcaaatatataaattgtaccttcttatgacttaatctggtaaaaatccattattttaatagccataatcccaagaatcttaaaacaaaatgcgtaggtatggctaacattaatatgttccaataacagtaatgtttatcttaactgtttttatttaaataaacatctttatggagagctaaccacaaaattaataacattacaatggaatttcagaattcaaagtattttggctagtatgtcttagtttttataattcctagacttgtccaacatcgcacagctgaaaagttgcacgtaataattgaagccagtgtctccaaatctaagttccataagttcataagctatagcacatcaaggacccagttcagagttaggttgtgtgttcaactgcacccactgtccccatccttctcctaactaggaggctacagctaatagattgcctctgttaattacagggtttgtaatccttctcagtcacatttcacctttatgactcttcacttgcccagctattgctctgggttcaagatgtagttcacaatgaggaatacaaaggacaaagagacagaagctccatagtttctcatgaggcactagttagagttccctttccttctcccaaactacatagtcccatgatggacagaagaagcagtagctacacttaggagttcctttcttaacctcacaatttgaataactaaagaaatactagatgaacataaacttatactatcacatacttttgtattttaaattattttttaagctttgcaacaagttacaactactgtaaagtaggtaaaatgggtactttggacacaatgcattttagaaaagcaccgaatacacattataaagtaaaataacagaaaaaaaaaaaagatgattcaggtttttgtctcatctctatcatttaacagctgagtagtttttcatgaatcattaactatatagtttcctcaagacgtctatcctacaaagatgtcctcaggactgaaagatatgagaaatataaaaatactgtgcaaataatgaacattttctaaaaatgtcagttatctcaacaagcaaacaatatacaaggctgtacacaagaaggaactattcttccttgtaatccctctcaaacattttaaagttatatatttataaccagtaaaatgtgcaatcaagtaatggttttgaagctaatttcagtatttagctaagtaacatttcaattaattattatacactgatgagattctttcttgatcacaatcagtgaaacctttgtaagagactattgtaaataggtagagaaaagccctgaggaagaatatataggacagaaaaatgatttctcttgtagaagggacagagatagggttttctattctctgctacttcagactgcaagaggccttataaacaaaagaagaaatgaaacaattaacttggtttgtacaaattctaaagtaaaatgaccagtcaaggtatctcagtagcttttccttcttttgaaaacatagaatttgaatatggattcaggggtacgcctatttaatgttttcatataaaacatatttactaagagaaatttcatacctcactacaagatgcaactgctctgtgtaaaggtgtcaaccatttgctgtctttggcattaactctagctcctgcaacaagaagaaaaaaataaattgaaatattgtacataaaatatttttaataaatctcctgaaatagtagttatatataatccaaattggataaatgacaattgaaaaaaaacttattttttacactttctgctgataaaattacccttagaatataaaacaaaattagccttttaaattgatataattgtccaataaagtcttagttttttaatttaaaacaaaataaacatcattttatatataggttagaaaagccacctttatacagagcatatccaaggtagaaatcagaccccattttagaatgtgtgttaaaaaaatcaaataaatgaatataagaatatacttggagataaaatgcagactattttaaagtcttcattacatttctttactaatgaatatatcacgccataaggtaatatgataacatcaaaatagttctccagccatgatttaaaacacattgtataagatagaaacaatggttacagatttagaaaaataattgagaaagaaatgaaccaactcatgtctttctaggttatacctaaagcttaagaaagaaatttttttaaacaaatcaattttgtacagttgtttaaaaatcattaagtcaatggacaaaaattaaccttaatagaatgcaaacacattaagacaaaaaaatttacattattcgaggagggaataatttatctcccatattaaatccaaatcaaataaaagcagcacatgcatggtaggataattctattaatatatctaagtagagaagaaacagccctggttcttggaagtatagaactggctgacagatcctatcctataagcaatcctagatttatatcccaaatcctaaatcactcattttctaaatgatgaaatacaggtatacaaaataacctaacgttggggtcaactataacagaaacaaagcttcatacttcctaacgcttacattatttctaggttttgagtgtgaggagtcagggaataatcaagtgcagtgacttcaagtaatgccttcaattagtagctctgggtccctaagtagttgtgtgatccctctgaacccaagtttcttcacaaagattaacatataataaatgtgcctagtacataatagcaaatatgttagaggtagactttaaagccttgaaaaatgagagaaaataaatgaaatggaggtgtaagaaacatccacaaatgtagtagttgagatgctgagagtagctgagttctctgtgggcagtggcagtgaggacacaaagaatcaagagctaattagagagctttgaacaatgctcacagttaggctatggaagaaggaaaggaagacagcaaataaagaaccagtcagagagcatgacatacccatgtaataaatatttgggcaactatctgccaggcactgtggaaccctagatggttaaaacacaaactgcctaatcacagtaatgccaacgtttgttttgggtagaagacggaatgtacaaagtacacacatttgaaatgtttgccagctggaagctggaaccctacagatagtgaaggagtgacacagaagctagcgtctttcgttttcccacttatctgcttaggacttcaatggttctctttaagccctgtgcctctttctacaggtttatatttatgtgcacatgcatatctatacacagtagaacggaaagctctggcagtaaggcccaaagggtatcaacacagacacctagtacagacagtatcctgaatcaacaaaggtaaataagaaatgaggtctcatgagggatgctgagaagtctgattcaaagtattaattagcaggagaatagaagggcacaggggctcatgactgtaatcctagcacttttgggaggctgaggtgggcagattgcttgaagacaggagttcaagaccagcctggccaacatggtgaaaccctgcctctactaaaaatacaaaaattagccagatgtggtggcccgcgtgcacctgtaagtctaattactcagaggctgaggcaggaatcacttgaacccgggaggaagaggttgcagtgagccgagattgcaccacacactccagcctgggcaagatagtgagactctgtctcaaaaaacagaaggtggctggcacaaaaaactgaggagactctgtgttaataaagatctgaaaacaaaaagtaaaaaagcagtaattgtatgactagtacgctttacttttatgtagaaaaaggaagagataattatttttatcttatcacacaatggtccccccttgtttcacttttcacagcttgttacccagtcaaccatggtctgaaaatattaaagggaaaattccagaaataaataattcataaattttaaattgctcactgttctgagtaacatgatgaaatatggcaccatcctgctccatccacccaggatgtgaatcatccctttgtccatcgtatcttgcatatgccattcaccctttccttatgggaccctcttgattatcagattgactatcatggtatcataatgcttgtgttcaagtaacccttacgttacttaataatggccccaaggtgcaagagtagtgatgctggaaatttgagtatgccaaaagaagcagtaaaatgcttcctttaagtgaaaagatgtaagttctcaataaaaaaaaaatcatgctgaggttgctaagatctacagtaagaacaaatcttctacctgaaattctgaagagggaaaaagaaacttgtgcatagtatatagggttcagtactatctgaggtttcaggcatctacttgggggtcttggaacatacctcttcaaaagggggtactactgtatttgcttaatatgcataaagaaaccctacaggaatgctaagatattaatgagagggggtgcttatacgtttgtgttggtggtgggaggcacattgaaaactgggcatatggaggtactagggtagtaatgcaactttatattatacctttaaatatgtatatatcggccgggtgcagtggctcacgcctgtaatcccagtactttgggagaccaaggcgggcaaatcacctgaggtcaggagttcaagaccagtctggccaacatggtgaaacccaggccctactaaaattacaaaaaaaaattagctaggcacagcggtgggcgcctgcaatccaagcttccaagctactcgggaggctgaggcaggacaatcacttgaacctgggaggtggaggttgcagtgagcctagaccgtgccattgcactccagcctgggcaacaagagcaaaactccgtctcaaaaagaaaaaaaataataaaaaataaaaaaaatcatgcatttcttctaagagcctaatcaaatgtttttaattccttggaaaataaaggtcaactatatgagaaatcagggctatatctgagggcaacaatgaaacaatattcccccaccaacattagttaacatgtgatttacaatataaacagataaatatgacacagtaatgtacactacaagagcagcagttggctgtgttcctgtaaaatgaaaaagagtgtaaaagcaacaaacatagcagcacatttcagatggttcagattcccagagctcatgtcagtgggctgtctaaagctaaatagagttctgttccacacagaatactccaaagttatctatatattcatatatactttaaacgacaaattcattctagaaatggaaaagacatttccagaatatagttaactagttcaatagctagttggagtattaaacaccagccacaacagctaataatgaggatggagatacaggggaggcagggagaaaccatacccacttaaaacaaaaaacagtctttgtagagagaaataaaaccaaatgtcgttaaccgcctctggtggcataatcacatgccctctacatggtagaagatagtatttgtggtttataaggatgaccttaagtaaccaacagaagattaatttctttactatttcctactcattaagacagaaaagaatataaaacagcagtcccttgtcatttgttgaagttaggttactggcatagcctgtggtgcgaaaaagcactgctaagaaacaaaagacaacacacatagcaatttaagaaagataccatcagtgagtactataaaccaatatttacagaaaacttacatgccagaagcacctcattaaattcaaaatggttatgtccaactgtataatcaatattttaacaagtcttttcttgtcccccacaaatctatgcataccaactgaactttcccttcagataaacggccagagcctatcctcacacatatatctgaatttagattcacctttctagagtagagatgtgactgagtttctgatattacatgcaataaataacacaactaaaaatcaactgcaggatcacctaaacaggttgtatccatttcataccacagttatagattatataggaaaacccagctaatcagtttcctctcacccaatctttacacgtaatatttcacccatataaaagtgcactctgaaacaatagttttgtaaaagaaaaggttacctaaatctagaattaaatgtctagctattcggaaataaaacataaattcaaaaacaaaaacttgatttacttacttacattagtctagggctctaggcagccagcaatgcagctgaagagaggtctaacgttgtgaagacacagtcatgggttagtggaaggaacactggagcaggagagatacgtgatctcataatggctgtataactagttggctgtgtgacctggaagtgtttcctggggcctgggtcttcattttgcaaatcataatccctgctcctaggctgtgtgtgtggtgaggtgagggggaggtggatatgaatatgtatggacaggattgggtgaggatgggccccagatttaaacaacaaagggcactctttctgcgaagttctacagtcagcaattctattaggagtatcccatttgactccagatttcattctgcaagacaactgattgacttattttctcctaatctaattggtcactaaattcttccaattctttgatttttgaacctcaattacagctgacccttaaacaacactggttcaaactgcatgagtccacttatatgtagattttcttccatctctgcaaccccagacagcaagccctccacttcctcttcaccttattcaatgtgaagatgacaaggatgaagatgtttatgatgatctgcgtccattcaatacacagtgttttctctttatgattttcttagtattttcattttattgcttattttattgtaagaatacagtatataatacatataacatgtaaaatatgtgttaactgtttatgttattagtaaggcttttggtcaacattaggctattagtagtttttagggagccaaaggttatattcaaagttcctattgtgttggggttgggggagtcagtgcccctaacctccacattgttcaagggtcaactatacctgtaaaataaagcattgtgctaaatcatccttatgatccatttccagttataacgttctatcctattttggaatattcagaataaattatgtcatacttattaaaccttgtcaaatggtctgaatgtttgcgttcccccaaaatttatgttaaaatcccaaccccaatgtcatggtattaggaggcgaggtcttttgtgaggtaattgggtcatgaaggcagtgaatgggattaatgcccttgtaaaagtggcccaagagcgctccctcaccctttccaccatatgaggttatactaaaaagactgctggctataaataagaagtgggccctcaccagataccaaatcttctggcatcacgatcttcccaggccccagaactgagaaaaatttttaagtcactcagtctgtgatattctgttatggcagcccgaaaggactaagacacctcactctaacattaaaaagatctatgttaggggtcttcaaactactatccacaggcttcaagccacctaatttgtaaagttttactggaacagagccacatctattcaatttaaatattaaatatgtagctttcactatgacaacagagttgaatggcctgtaacttgtatcttgccagagtctgtatggcctgtaactagtatctggccctttacagaaaacgttagccaacctctgatctaggctaagaacttgatagtaggtactattaaagttattgctaactttatacatgtttgtaataattataaatagtctcacaaatcattttccaaaacttctatttgcagagaattgttttcttccttgctcctaaatcacagaggagatagtccataaccagtgagctgggccagaagctaagtacttttatccctcttcccaaactggaaataatgcttttctttggctacctaacagtgcagtggcaaaaggttcagattcggttttcaggctcagagtagaatgagcaaaaaccaatgacatttccacttttccaactataatgctgaaaaaaatagctgctgcactgtatcttttaagagtgttgtggataccagctattgtgggtttgttcaactcccaacccctggcaactcagaatatgactttaactggagatagactctttacagaggtaattaaaatgaggtcattagggtgggccctaatacagtatgactggtgtccttacaagaagaaatttgcaaaaagacatggacagagggaaaataaagggagaagacagcgattttgcaagccagagagagataccctgaacagatccttccctctcagccttccaaaggaatcaatcctgacggcaccttgatctcagacttacagcctccagaactttgagtaaataaatttctattgtttaagccgcccagtttgtagtactttgttacagcagccccaccaaactaatgtaccagcactgaagtaaaaagaagagacacatactttaggtttcattcttaatgccagaaacatcagaacggtgttttctagtaaggagagtattttttataaaaggccaatcgaatgaatttttgacaaatgccttccacaatgcagtcatttaaggacttaatacttactggaggcagtctaaggtctgaggtactgctaaccatatagttttgaatgcaagcattaagtgaataagctcccaaacaaaatatctatacctcagtggccagcaaatagtctttaaaagttcttcaataaaagtgacttcacatgtaaattttactaaaagctaaataggtggttgggggaggagggtggaaattatggtgggaagaaaaaaggaagattctgattacggcaggattaagaacacggattctgtagtcaaactgcctggatctgaattctgcctctagcttttactagcagtataaaaactttgaaagtttaaaagctaaatgtcttagtttccttatataataccttcacaaatttaggctaaaatgagattagtgaaatggctaaatttaacagtatttaaaatgtaataagctcactgtttgctattatttcaccccattccataataattattaacattaattccagtggactctagtattactatagattctatggatgtattcacttgtttgattacaggtgccacgccaaaaattatacctctcatccacaaatcttagagttgcatcatgtacaaatacttggtttctgaagaattctggactgcaagttaaagaaagtgagtagttttactctaaaacaagtcaccaaaatataaaagagaatgagaagagataccatcttcaatacaataaggaaacagttacaaccacaaaccaaactatgaattatttctatcaataacagtgaaatgtgtaccaaactgaaggacactgagtcaagcgaagcttcttcagatcttgggaaggttaccgagtcctctaaaaagtcatgtttgcatgtgtgtcccatttgctcctttctctctgctgtgtcctaaaatccctaaaaatctttcagacgatctagagctgtctgggtaattcacaggaaaagcacctacagaactcttaacctcacactgcataagaataaagtggggcagtgctaaaaaagagaccaagaaggcatctttattaattttttacccagctggagatgagggagagtaacagccaatcaccagcagattactatctaagaactcattgatctaagaagctgctgagccagcccaactacctgtggtatatcaacaaaaaaaggaaactaaatgatgagaacatatggacacacagagggacacaacacacactggggcctatcagagggtggacgataagaggagagagaggttcaggaaaaataatgggaactaggcttaatatatggatgatgaaataatctgtacaacaaacccacatgacttaactttacctatataacacacctgcgcatgtactcctgaacttaaaatttggttacttaagtttacctatataacacacctgtgcatgtactcctgaacttaaaatttggtttgagagttatttgaagaaacaaacctaacagatgttcactttttgccccttcctttctgttctgcaaagaggcatattcctcgaagatacgtaagaatctgaaagcatccagcacaggactaggataaaaatatacagagtagagtaaactaggagaaatgcagttggaaaaaaccatcccagaaaataagatgaattcatgagctactctatatactcaacttcactgaatttaagttctgaagaggagacctcaaagaaaagttacaagaaagagataagacaatgtagagagactatgagagctagctgagtttggggaaaaaaggaaaactattaaagataaaaacctagaaataacaaaaagtaggataaacatgacttaaaatggtcaagaatttgaagccaaagccagagaatcaatctttaaaaacataagtcagagcatgttattccactccaaacagaactctccattggttttccacatcacttaaagggccaaggcaacacaaaagagtgaaaccaattggagaaaatataaatatccttatttcctaatttttaatcacaagtcagacataataaaaacctgaaatatgaacacagaaggaaatgactctaaaataatctcaatctttctatttttttatgttagagaaatatatttagagaatatagaactcttgctatggatatcgcagtagtttttaaaatacaaaattacagtaactgactattgtatgttcttatgaaaacatatgactttaatgcaatcttacacgacttttatacaaataagcattatttcatattgcttaatttacttaagattatacctacctgctactaaaatgtggtgttggtaattaacatgaagtgtaaacacctacactaaattttcattactaactataaacaaattagcctaattttgttgcctatatttctcttcatgtatttttttctcatctttacctagagaattgatcagatcaaatatctagtttcaattctaatttataactcaacttaccataattcattaaaaggctgttttgatggatccagaatttaaaattagggttatagaaatcagtcagtttaacttgggcctcagcaaccatggcattcaaaccaaatttaagcagaactcctggagcatctatacagaaccttatgagtctatatactatatattgtctgaagactattcttctgatatttattctgaactaaaatttggatacgattagtcttttactaccctgctattctggaaatctatttccaatataaaagtaagaattcactggttagcttatacttgacttctaaaatgtgtagtatatcttctgtaaaactgtcctaatcaactttcaatttaaagagttaataggaatttaaaatggatataacatgaatgaactgaagaaatatccaccaatcaaaattccttcctgatcaggtttctggttcagatttcaaaatctctcctgggctgggcatggtggctcacagctgtaatcccagcactttgggaggccgtggtgggtggatcacctggggtcaggagttcgagaccagcctggccaacatggtgaaaccccatctctactaaaaatacaaaaattagttgggcctggtgatgcatgcctgtaatcccagctactcaggaggctgaggcaggagaatcatttgaacctggtaggtggaggttgcagtaaaccgagagatggtgccactgccctccagcctgggtaacagagcaagactatgtctttaaaaaaaaaaaaaaaaaaaaaaaaacaaaacaaaaaaaaaaaaactctcctggttccttcctcatttatgtgaaaggatatttttataaaaggctatgggagttatcctctatagtgtcaactttcgtaagttaaatacacatcctgattactacctatctttttgttagagctctgttatccataaattacaggagcccttactatttcctcaggggagcaaatacctaccctgttcaggaaggtacttatatcatattaaagctttaaaggctgtttcttgattgtagaatttaaaacatataaatacacttctccagagtatatagagtctattttttttcaacctttgtctttctagattgtggaaataaattatttttcattttcccccagtaggtaagtcattccttcctctttatcatttcagaacgtaataactggacttcaaaactgacagcggagaatttttaagaaagcatatctaaaagtcacagagaagataattcctgatatcaaggaatttatttacttggcagaaccaaaaaagtgaaggaaaaaatagaaatgctccttaaaaaaaaatagccataattttgaatactatatgccagggacttttctaggtatcttaatgacataatctcatttgcttctttaagcctataaattttatattattcccatttttttagatgaggaagttgaggctcagagagcaaataaacttcaaaagatcatggaggtgctaagaggtaaggccaggactgtatccaaatctgtctggcaaaagagcttgtgacattcacactatctgtagtgtctctcatggcaacacaaagcctggtttatttctttattttttttgtttataagcagaaagctgaggttctagttcaatagaaatctagccttggattttactccagctaattttactccaaacccatgtaagtttttgttttatttttcctaaattagagcctaactggtaagtctaaagagaaaaaagtctaagaccctgagttgcactcaaagacaaatcattcgccttctttccctttccacttacctgatacccttcaacccttaacttctacccatccccacctctcccattctcatttccattaaagacttgagaaacaaaccaaaatgtaaacaaatttctgaaaaggagacacagtctaagcttatattgctataatcaccatcccaggcactttaaataaatatgctaggaaggcaaagtagactaactgcctgccttcttggagtttacattctggaggagataaaacgacagtaaacaagtaatttaaaaaggatgtcaggtaacaataaacactaggagaaaagataacacaggcgagggggattaggtggtagtggtagtgaccaaggaagatcttgttgatgatgcgacatctgagcaaggacatgaaaaggttcatggtgtaagcggctgaagaaggtttaaggctaaggaaacagcagtgcgaagaaccagaggtagaaggcagccagtagggttagagcagagcaaacaaaaagagagtagcaggaattcaagtcagaagaaatctggggtggggagataatgtacagctctaaggccaatgtaaaaacttaatttttttttattgagaactgagaacaattgaattcatccaaaattgtatttttcctttgaaaaatagctacatgagctatattacctctttacactgataaaacattaaaagtactttttggctgggcacagtgcctcacacttgtaatctcagcactttcggaggctgaggcaggcaaatcacctgagaccaggagttcaagaccagcctggccaacatggtgaaaccccatctcttactaaaaatacaaaaattagccaggcctggtgccacacacctgcagtcccagctactcgggaggctgaggcaggtgaatcgcttgaacccgggaagttgcactgagctgagattgtgccactgcactccagcctgggcgacagagcgagattctgtctcaaagaaaaataaaaaaagtattttttaaaggtaagttcaaatagctttttatacaagtatcatggttaattttacacatgatttgtacttggattattcagaagaaactaagcattctctcaaatgcttatttcacagctgacatctagatactatcatgctcatgataagactcatttgaccatcatacttacagaaaccaggaagtcaaccttctacaagtaactaaaaatccttgttgcaaacattcacttttaaaaggaagggattaagtcaactttgagcatttgaaaagtttctcctgggtgtaaaaataaaaaatgaaaaaaaaaaacaaaccctccacgtggaatcatataaaataatatttatgacaaaacaaaaataatcagaattctgtgttaaaataaaaaatgcagcagtagacttcttatccagtcctaaactgtttcttggatgatgtttgtgtagaaaattccataaacttgagtcccattaatttatattattaaaagaaataattttgtcaacctcctcagttcttatcttgagtaaattttagctgaaaattaataaggaacaggcatcttcagggaagtacatcagcggtgaaattattcataaagaagctaacaaaatattagccaggtccatgtttaaccatatttaattttatatgatcatgaaatctgatatagaaataaggtattttttaaaaatccaactgattcttaaatttttatgaatttgtaacggcaaaactctgggctattatttaacgaaatcttcacacaaaatttctccctctgagccctcctttccacaaactatcaaaggaatactactactaatccaatttcattatgcatgtaggtatgcaatttggcaatacaagctcaaatcaatgacatatatcctttcccaataaatatcattacaatcatctggctataacaaaagtatttctaaactctgtctgtctgcttgccttttttgggactgcacgtagtctgaccacaataggagctattctatcatagacagttctagtattacttcatattataaagacttaaatagtttagaaaaaataataaaggagtataattgactaaaagcattttacaagccctcaagtagggttagataaaagctatttaaacacagaaatcttactggcattgccttcaaaatatatctactatcagactatttcttactgtctccactgttgtatttgctataaaccaccgttacctccacctaggagaactgcaaccatctcctataattctgtgctcaatgaggcctactataactgttccatataataccctatgtaggcgggcatggtggctcactcctgtaatcccagcactttgggaggccaagacaggcagatcacaaggtcaggagatcgagatcatcctggccaacatggtgaaaccccgtctctactaaaaatacaaaaattagctgggtatggaggcatgtgcctgtaatcccagctactcgggaggctgaggcaggataatcacttgaaccagggagctggaggttgcagtgagctgagatcgtgccactataccctggcaacagagcgagactccatctcaaaaaccaaaaaccaaaaaaaaaaaaaaaaaccaaccaaaaaaacccgctacatataatgcttatcccaccccgattatcctgatctacctttcaattttttcaaagcactcatcatcatttaatatactataaaattcacttgtatttattgcttgtttttccttatcagagtataagctacaagagggcagcaatctttgttttgttctttaatgtactctaagcacccagaaaaagatatgtgatcagtatttatggaatgaatataaaaataagtttcagctgataaaacaaatatgaacaacaggccatgcagtaaatagtcaattatgattgagaaacattaagaataacaaaaatatacataatgtgttcttattactcagaggttaccataccagataaaataagaagttcaatgatttctgcatctccaaggtaagctgcggcgtgcaatggggttcgcttttcattgtcctgtgataataaggaaaggtgggaaataagttttaaaataagattaattttaataatagttttaataaccacaacaacaacccctccccccaccaaaccattattaactatcaacttattacttctataactctagcctagtctgcaagtcccaataaaataaaaggatgtgacaagcccgggcaacacagcaagaccttgtctctacaaaattttttttaacaattagccaggcatggtagcatgcacatatagttccagctaggagaatcacttgagcctgcaagtgaatgaggctgcagtgagccatgactgcaccactgtactccaccctgggtaacagagcaggaccctgtctctattaaaaacaaaaaaaaacaacaaaacaaaaacacagggtatttccttgctaaggcaaaagcctaaaaaaatacttgaccttaaaatagtggtataaagtccagcaaagaataaaaataaaaatctaaaatgacaaagaaatagcaacactttctttgaataaagatgcttgtgctgctgatatatataggaaaattttacttcatactaattttttcgtcagtatatttccacagttttacagtttagaactgttaacctaaacaaaccaaaagatttgcttatcaaaatgttttcacaacagtacccttaggggcaaaaagggaaaatatttcgggggattcgacattatactttaaagcaattttaagttttttcttaacattcctgctagttttactttcatctccaaaatatattcatgtctgtttcaatataaaaaatacatactcatccaaatcttcctccaggaaaagaagctacctctaatgcatgcttcatggacctcctaccagaaaacaacagtgctctccagttcaagatgcaagattttagagtaatgtcacattcagggatttttaattcatagataccctatctaaagttacaacagagtattactgacttggctgcatttgaaaaaaactattcagaaatactcacattgaaacttacatccctcatttttgataaaggcttttgtgacagatagttagttgttttccactatgttcttccttttgtccacaggaataaaattttagctggtcacttagccacccagtgagagaatacattcctggcctcccttgaagttgttgcttggtgtggaccaatggtatgtgagtggaaattaataatgggcacaacttccaggtcatcttcaacttaaaagacaactactctaggctgggcacagtggctcacgcctgtaatcccagcactttgggaggctgaggtggcgggtggatcacgaggtcaggagatcgagaccatcctggctaacacaatgaaacctagtctctactaaaaaaaaaaaaaaaaaaaaaaaaaaaaaaaaaaaaaaaaagccgcacgtggtggcgggtgcctgtagtcctggctacttgggaggctgaggcaggagaatagcatgaacccgggaggcagagcttgcagtgagctgagatggcgccactgcactccagcctggatgacagagagagactctgtcaccaaaacaaaacaaaacaaaacaacaaaaacaaaaacaaaactactctagaaaggggctaattgtttcctgcttcccacaggctggaaggcacatgtgaaactgagcccctttgaccatggaaatgcaggccaatatactagcatactgtcaagcaacaagatctggaataaataatcctacagaaaagagctgccttactagcttggatcactgactttcatgctattaagataaataaacttatttaaagtaggtagtatatttggggggcctcttaccatattagaatactaatacagttttcaagatttaaacaaatgaaaaattatacttcattttgtaataattttcttgtttaggaatcccttaattactttaagaaaaaatagttgggctattgagaattaaagtaaaaacctgcttgctaggcaaaagaaggattaaatatctacaggcaatccaaaaaaggcttagctgtagtatgtgatgttattatacagacgtatcttaacatttgggaggctgtggtgggaggatcacttgaggccaggagttctacatcagcctgggcaatatagtgagacctcatctctacaaaaaaataaataagtaaataaattagctgggctggtggcatgcacctgtagtcctaggtactcggcaggctgaggtaggatggcttgagtccaggagcttgaggctgctgtgagctatgaccatgccattgcactccagcctgggcaacagagcaagatcttctctggcggggggcggcggtggggcaggggggcaaatgtgtgtaacatataattatcactggtctcttcaaacatttcttcctataattttaatgctgcttttgtccttaaaatagtaacaggtgttccagtaaagggaggttgatatagtgccaataatgttaaattgttcagtaagctaagggttctttctctcaccacaattagcacaagaccttgttttttattccaacatataccaccccaggaaacagaatgctctacacagaaattattcaacaattgttgaaagagctaacacagaaccactaaagtaacagaatacatgcaaagatgtgtcctaatttagtcatttttttaaaagaaaggatactttgcctaggcttttcagtgttactcattaacacagcaaacttcctagagtgtttaaatatgatcagatttagtcaaactgagaaacatctattgcaccagataaaccacacacatagcacaacaacacagaaagtgagtcatctgtgtgtgagggatgtctggaattctatgactcaatgcctctcgaatcccattaatgtgttttatgattcatatgaacacagtttttcctctctgcaaatcaatttgaagaaaagggagaaatacaactggctaattttgaaagaaagaatttatatatcatattttactacagttaaacattgaaaattaggtaataaaatatttaagatttctttcaccaaaatgtattaaaattaaaaagtgacgatccccttagacacagtaattccattttaaggcttttttaaaaaaagcctacatatccagataaaatgattaagtatatttattgaatcactgtaggaggcaaaatgctagtaacaacttaaatgcccactaaatggttacctaaaattataaaacacaaaaaattcttaatctttatttaactgactcacaagattaaccaatatcctcggcttcctgagtaaaattaatagatgactttggcacattaaatattctgactagtagtttaccactaacaagcctacacagttttgctcccatgatggggtatgtttatcaagggtaagctgtgtttgttaccacaactgaagaatcaataaaagcaaactactgaaaaaagggaagtgctattgaattgggtatggctgagacaattggaaacactaaggcaaacagtgaacagtaaaaaccttaggggttttgccctaagattatttcttaagggtctaatttctcacatcagctacagaaactcaaaatggaagttatagataatgcactgtgagtatggtctgagcaaggaagagtacactgaacacctgtcagtggactccacatccattgaaaaagccttggtctaacttaaaaaaaaaaaaaaaagttatgtaccttataggcactagaaaggatttaacaaattatgttagtggagaacacttgccatataggttgtagaagacttccatattgactttgggtatgagaatgaagcacattttagaactacctctgacagacaactgtaaaacaactgttaaaactagttccaagatgcatgctatgatcctcttcctccaaggaatactttgaaaacctctgtggaaccttaaagtttcagattataatatgaaatatcattagcatttatcagagcaatgtaactttaaagaaaaatcataaatagtccacatttctattatcatccttaataattactatgtattgaatacatatatatacatatatatatatatattagatagcattactgggtacagaaatctaacttaaaccagtttaggcaaaatcgatttaaaggaaggacactgaagcatctaatggaattgagcactgaacaaccaaaattgaggaaaggcaggcatgtggctaggtcgtaagaacaattgaaatcaaacacttgaaacacttttgtctctgtttcttctctgcacatgagctgctttttctgtcttcacagaacactttttttcatggtagggaataagccatcccaactcctgatatttactcttagaacttcagcagcccaaggagaagtctcttaattcaatctcccggaagaatatctgattggcttaatttggtgctcaccaaatttgctcataaatttaatgcttacttctatattaactgaaagtaggggaagattaacatggcagttcctgtagtaactatgtagaatggtgagagtgtcttagagaaggagagcaaacctgaagatttttattagtgcaagccattgcataaagcacttaacacatcttatttactgtgtaaaattattgtacaatttatagcatgcaacaaaaggatgaacattgtatcagtctgttttgcactgctacaaaggaatatctgagggtgggttatttataaagaaaagaggtttatttggtttatggttgtacaggctgtataagaagcatggcaccaggcagggcgcagtggctcgtgcctgtaatcccagcactttgggaagcccaggcgggcggatcacctgaggacaggagttggagaccaacccggccaacatggtgaaacactatctctactaaaaatacaaaaattagccaggcgtggtggcgggcacctgtaatcccagctacttgggaggctgaggcagcagaatcgcttgaacctgggaggtggaggttgcagtgagccgagatcccgccactgcactgcagcctgggtgacagagcaaaactctgtctcaaaaaaaaaaaaaaaaggcatggcaccagcatctgcttctgatgagggcctcaggaagcttacaatggtggtagaaggcaaaaggagagcaggggtgtcacaaggtgaagagagtgatcaagagagagaagagggggtgccaagctctttaaacaaccagctgttgcatgaagtaggagagctagaactcactcacatttactgctgggaaggcaccaatccatttataaaggatctgcccccatgatccaaacatttcccattaggctccacctccaagattgaagatcacatttcaacatgagatttggaggggacaaacatccaaacgatatcatttattttcaaaagcacttgaaacatttagataaaccatattctgagccaaaaccaaaccttaacacattaaaataaagcaaaatcatactaagtatgttctttggccataacaaaattaaattggaaataaataacagaaagataacctgacaatttgaaaattgccaagtatttgggattcaaagcatatttcagtagtaaagtagaataaatgtagaaaactacttctaaataacccatgtaaagaggaagtctccaagaacattagaaaagtattttgaatggaatgaaaatgaatacaacacattaaaatttgggggataaagttaaagcaatagagagcaatttatatattaaatgtttgtatcagaaaagaaggtcttaaatcaataatttaagctttcacttaaactagaaaaaagggcaaaataaccagcaaaaaaagcagaaggatgaaaatgataaagatgaaaacaaaacaaaaacagagtatcagtgaactcaaaagctgattctttgaaaagatcaatataattagtaatcttcaagtcagaatgatcaaaggaaaaaatagtctgtatcataactaagaggggattatcaataaaatccccaaaacataaaaagatgaagccaacattatcatcctgataccaaaaccagacaattacaaaaaacaaaaaaacccagagatgaatatcccccatcaacagagacataaatatcttcaactaaatatcagcaaattgaattcagcaatatttgaaaagggtactacatcacgaccaactggagtttattctgggatcacaagtatcattcaactaaaaccaactggtgtaattcaacatattagcagactaataaaaagaaaggtcatataatcatcgcatttaacaaaatccaacatgtactcatgatttttaaaaaaattatttatttattcatttatttttgaggcagagtctccctctgttgcccaggctagcgtgcagtggcgcgatctcggctcactgcaacctccacctcccgggttcaagcgattctcctgcctcagcctcctgagtagctgagattacaggcacatacaaccacgcccagctagctcataatttttaaaactctcagcaaacttagaggggaactttcttaatccgataaagggtacaacaaaaatctacagctgacaggtaatttaatggtgaaagagtgaatgtttttttctgagataggaatgaggcaaaaatgtctactctcaccactcctacccaagtacttgtcagtaaaataaggaaaagcaaaaaatcttatcaattgagagggaagaaagaaaagtatctctagtcatagatggcatattatttataaagaaaatcccaaggaatctaaaaaaaaaaaaaattcctagactaagtttagaaaagttgttgaatgcaaggtcaatatacaaaaccaactatatttcttactagcaattaataagtgaaagttatactaaaaaaaaggtatcatttagaatagcatcaaaaggtaaaaagagaaagaaggaaaataaatgcttaagcataaatctaataaaaatttgcaagatttgggccagatgcagtggctcactcctgtaaacccagtactatgggaggctaaggtgggcggatcacctgaggtcaagaattcaagaccagcctggccaacatggcaaaaccctgcctctactaaaaatacaaaaattagctgggtgtggtggtgtgcgcctgtaatcccagttacttgagaagctgaggcaggagaattgcttgaacccaggacatggaggttgcagtgagccaagactgcactcctgcctgggcaacagagtaagactccatgtcaaaaaagaaaaaaaaaatttcaagatttgtatgctgaaaactatgaaacacgcaagaaaaaaatcaaagaacacctaagtaaatgatgagagaccatgttcatgaattggaagactcactattgctaaaatgccagttttcctcaatttgatctatagattcaatgcaatcacaataaaaatcctcacaggatttcttgtagatattaaaaagctaaaatttacgtagaaagacaaactaaaaaggcagaaacaatttaggaggaacagcaaagttgggggcctcacgctgtttgactgcaataattactataaaagtgaagtaatcaagggagggtggtatgagaaaaaaggcagacatgaccagagcagagtctagaaataaacccacacaaatatgattgatttttgactaaagtacaaaggcaagtcaatgtagaaataatcttttcaacaaatagtcctggataatcacatgccacaaaattaacctccatctatacctaacacctaatatgaatattaacttaaaaggaatcatagacctatttcccaaatctaaaattattaaacttagaaaattgtgggttgtgtaaagagctcttagatgcaataccaaaagcaaaatccatgaagttaatgaattaaacttcatcaaaatgagacttttgtactgagaaagacatagttaagaggataaaaagacaaagcatgcactgggaaaaaatacttgcaaatcacagatctgacagagaacttgaattcggaatatataaagaactctcaaaactcaaaaataagaaaaccacccaacaaaatatgggcatttaaattatgctgggacaatgtggtacctatttggaaaagaatgaaaacaaaaaccaaacccaaacactacctcacattatatgtataatttaactgcaaatatattataaaactaaatgtaagcagcaaaatgttaaaagcactcatatatgaatatggaatattatctttacaactcaagttagggaaagacttctgaaacaagatatcaaaagcattaactatttttaaaaaactgaaaaacaaggcataaaaaattaagacctcatgtttaattataccataaagaattctgaaaagacaagtttgaatgggagaagatatctgcaacacacgcaagtcaaaaagggctcatatccagaatataaaaagacccgctgcaaattaataagagacaactcaaaagaaaagtaggcaggagatttatttatgtatgtatgtatttatttttcagacagagtctcactctgttgcccaggctggagtgcagcagcacaatctcggctcactgcaacctctgcctccaggattcaagcgattctcctgcctcagcctccccagtagctgggactacaggtgcccaccaccacgcctggctaacttttgtatctttagtagagatggagtttcaccatgttggccaggctggtcttgaactcctgacctcaaatgatccacccaccttggcctcccaaagtggtgggattacaggcgtgagccactgtgcccggcccaggagatttaacaggtacttcataaaagaggctggctatatgcatgcttaattaacatataaaatgtgcctgaaactgtcataaaaaagcaagctaaaataacaacatacaactatgtaggaggaaaaatcagtttttccccttctactcacacaccactcaatacaaaactgatacttgatgtgtggaggttgtttcctcataaagcaattccccggaggacaccagctgggtgtactctaattccatttaatcctgacactatctacctgaagatagcatcagatctcaaagtgagtgctcagtcccaaaagactgccccttacttcagatgccagtccctactagtaggttttcacctatacttctcaccaactggctataaattgaggttcccactacctctttctcaggtttgattagtttgctagaggagctcaaataattctgggaacactttatttatatttactgatgtattaataacacaaaaaagggtacagatgaacagccagatgaaagagacgtataaggcacacagcttccacggaagggcgtgcaacttccattccctctctgggtgcaccaccctccaggaactgccacatgttcagctactggaaaatccctgaacccagtccttttgggcttttatagaggattcattacataagcatgactgattaaataactggctactggtgaccaactcaacattcagtccctcttctttctccagagactggggggtggggggcttgaaaagttcaagccctctaatcatgctttggtctttcaggtgacaagccctcatctttaagctatctgaggggcctcaaatagctcagatagcacctcataagcataaaaaagacacttatcaccccagaaattacaagggttttttagaagctgtatgctaggaaactggactatgtccaaataaacactttaccatatcgtacactacatacttcaaaaaccaagaatgtggtccaaagatgtggatgaataagaattctcacacagtgctcatggaagtttaagttatttaataatatgacattatcaagtaaagctgaatatatgtatagccaagtatttatactatagaaatgcacgcttatgtgcatcagaagacaagtttacaaatagctgcatcattcaaaatagaaaaaaaatgtgaaacaacccaattatccatcaatagcagaatggataaactgtgttggatgcattcagtggaatcaggtcaatttttaaaacaaaatagcattgcacaaaagaacccagactcgaagaaaatatactgtatgatccatttgattcaaaatatgcaaaactaaattatattgcttggggaagaataagtaggtggcaaaattataaagaaaaccagaagagactattataaaaatttacgggtaacactgaggggtggggtggaaagttttgatcataaagtggtcaccaacaagggcacttctgaggtgctaatgatgttctgttttctgatctgggtcgtggtgacattcacatattcattaaattgtacatttgttttacataagtttattatatttcctaattttaaaaaagttaaaaggaggaggaaaaagttggttatgaaagtgtaaccattcttccaaaatatcaattaaaacacatctgaattaagaggtaaaatatatcaaagaattgacagaaaacaaaagctctgaaatgatatttccagcctaagaacagtcgttgcttttgttggtttaggaagttttgttctcctgaactaatgttcaaaatgaaaaaaagtcacctgggccaggagcagaggctcacacctgtaatcccagcactttgggaggccgaggtgggtggatcacaaggtcaggagatcgagaccatcctggttaacgtggtgaaaccccatctctacaaaaatacaaaaaattagctgggcttagcagtgggcatctgtagccccagctactcgggagattgaggcaggagaatggcatgaacctgggaggtagagcttgcagtgagctgagattgcgccactgtaccagcctaggtgacagagcgagactccgtctcaaaaaaaaaaaaaaaaagaaaaaaaagaaaaaagtcacctgaaaactgaaaaaactacttatcctttatctacccatgccccctccccaaagcatcaatttggttctacacggaatcaggaataaaagtagaaattttattaccagagatctgtgcaacgcaatcttagggtgtgggggaagtaatctagtttctgtgtaaataaaaccccaaaccctcactgtacatatttatcttccaaaccaatgatgaaaccttgacctacagtatttgtaactgttatttatttctcatatacaaagacacatgtgttctaaatgatgagtttattatcttttgaactagtcaagtgtcagctgcccaagtacaattaagctaaacaggcttcttttcaataaacttgaaacagaaagggcgaaacaaaacacatgtgtacccgaaatatggagaatggtagtattctcttatgaaatagtaagtttgttatcatttgcagttttctgtttatggtctgtcagagcagtgacttcagaggggcaacctggacagttgactgctcccatcaccaaaaccaaactacacacacacacacacacacacacacacacacacacacacacacacacacacaccctctccgccctagccccgtcaatacccacacataatataaccaaatacctttagatcataaacttgctgaagtcaggggctatgttttctttatattcattcgcttctaacacttagtaatttgttatgcagcaataaaaaatgcgtatcatacataagtatcttttttctggagctcctttcgtggtctcccagctggtattacatcagcctaataggtgtccatagcactctgaacgtctcccttgtaacaatcatcatattaattgacttgtttcatgttcaatggctctaactctggagataggaatcttgtttattccctgtttttatacccagagtatgataaatagtagctattttaaaaaagtgcaacagcttaaaacaaataatcttttagttcacagttttaagggcagtaattcaggcatggtgtgactgggttctctgctgagggttacacaaagttgaaatcaaggtgttgatgggctgtgttctcacctagagacctgactaaaggaaaaaaaatctgttttttggctcattcaggaaatggtcagttctttgtccttctaagacctccattttcctttcccagttgtcagccagaggtcaccctccactagcagagaatgcctgagttcttaccatatggctccctccatcttcaaagccagcaagagagaatatccttcacatcaaatccctctcatacgtctaatctcctactctctttgttcctaactctagacccagatttagagttcatgtgattagggcacacccatctagataatctcacttacctagagtcagctttgtgctctgccagatgacataaactaatcaggaatgagacctgatatggtttggctctgtatccctacccaaatttaatcttaaattgtaataatccctacgtgtcaaggatgggactaggtggaggtaaatgaatcatggggggcagttcccccatgctattctcatgataataagtgagtctcaggagatctgatggttgtataagtatgtagcatttgccctgctggcagtcattctctctcctgtcaccctgtgaagaggtgccttctgccatgattgtaagtttcctgaggcccccacagccatgcagaactgtgagtcaattaaacctcttttttaataaattacccagtctcaggtagttcttcatagcagagggagaacaaactcatacaataccctatcatgcttacaataccagaaataatacaggggaccatcttaaaagtctgcctaccataaactgcagcctgaaagcttaagacgaggcaaaggaagagggtgagaatgcaggtacaactgataatctgatataaggaaataacattaaaaagcagggagaagaaattatgcatgattggacttgccttcacaggaaccagcatagtaactggcacatattactagacaagtgaataaaccaacataccaaatattatcaaattaaacaagcaagtatttactaaagagcttatatgcttatagctacaagagaaaagaaattacttataatgctaagccactaggtagaattgagaggtgacataccagggcagacaatatggacaaaaaactaaatttgacataaagaaaactgcgttaagatatctttgagatcttggaaagtgaccaaatggaagcaaccaaatcaaataattccaagggccttagttttgcctcatctgtaacggagttgatttaactacttaatctttaagatccctttccagtgctgactatcctacaatatggaaggcatggttcttgccccaggacaaattccctgtaggtattttagaatctagttattaattcatgttgtaatctagacactgctctataataatatataaaaatacagacagcatcctattctaagtactgaatttattccattctacaaatttagcagtaatcagatatttctaaggcttacttgctttttgtagaataataaaacactaaaattacacatcaataacaggtcctgtaaaggccaaaaatggcaggcccacagctaacatcacacttaacgtacaaagttgaaagctttcttctaagacgagggacaagaatgctgcccaccctcaccactcctatccaccatagtgctgcaagtcctagccagaacaattaggcaagagaaagaagtaaaaggcatcctaataaaaaagaaagaaatgaaattttatttgcagacatgatcttacacagagaaatccctaaagagacaccaaaaaatgactgaaactgacaaatgaattaagttgcaagatacaaaatcaacatacaaaaaaaatcagtagcctttctgtatactaacaacaaactatctaaaaaggaaattaagaaaacaatcccatttataatagcaacaacaaaaaaaagtaacatatttaggtgaaaatttaaccaaacaggtaaaagatctgtatactaaaaactataaaacattaatgaaaacaaattgaagaaaacacaaataaatgagaagatatactgtgttcatgaactaaaaaattaatattgttaaaatgtccatattatccaaagcaatccacaaattcagtgcaatccctatcaaaattccaatgtaatttttcacagaaaatagaaaaaacaacccttaaattcatatgaaacaataaaagaccatgaatagttaaaaacaataaccagcgaaaaaaacaaagctggaggcatcacactgctgatttcaaaatatattataaagctactgtaatcaagacagcatagtattggcataaaaacagacacagtgaccaatggaacaggacagaaagcccagaaataaattcactcatttatggtcacttgatttttgacaaaggtgccaagaacacataatgtggaaagaacagcctcttcaataaaagatgttaggaaaactggatatccagatgcagaagaatgaaactggatccttatctcataccatatataaaaatcagctcaaaatacattaaagacttaaatataagacctgaaattataaaactataaacaaggcggggaagcaccacaatactggtctgggcaatatttttttggatatgacctgaaagcacaagcaacaaaaacaaaaactggcaaatgggactgcattaaatgaaaaagcttttgcacagaaaaaaaaaaaatcacatgtatatattagcaaaccgtatatttgataaagaatttatattcaaagtatataataaactcaactcaaaagcaagaaaacaacctgattaaaagaggcaaaggacctgtcatgactaattttaggtgtccatctgactgaattaaaggatacttagatagctggtatggcattatttctgtagaaatccatgaggatgtttctggaggagactggcatgtgagtcagtggactgagtggggaagatctgccctcattgtgggcaggtctggatggaacaaaaaggtgaaggaaaaaaaaaatcacaaacaataagtgaagtgatggatatattagcttgatttaatcatcccacattgtatacatataccaaaatattacattgtactctacaaatatatacaattatgatttggcaattaaaactaatattaataataaaaagtagaggtgatgccatctgtgactggacaattgtaatcatcaaatgcaatccagttgttcggcaggctaatgtttagaatttctattccagaagtactgctggaatataaaagaaaattaccatttcacaaaatatgtaatgtctaagtctgaaaacattcagtggaatgtcagctgcttcaatcaataaaattcttaatgctgtatacaaagttttgttgttgttgtttttaattccctgtgagtttaggagacagtctgcagcgaacaaaggggctggaattctcaggacagagcaacagaggagaaagtagtacatggagagactcccaaagatctgcagaatctcgccttagtactcaactgagtactgagtgggaaaggagtgtaagaatactacctgaagctggtgaaagaaacagcagtgtttttcaaccttttcttccttactactcttttctgacagtttttcctaatcattccccatgaaatcttaataccactgtatttctaagttatgcattttggccatttagagggccacaaatcattggaatatgtaagatttttcatatacctacatacccacaaagaatctatttcctctcaattaggagtgatatcacctccaacgagaatgacggatcacagagaacagagtgttctgttccaactagccagttagggaaaactaataattcctggagcatggagtagagtactcaggagaaacttgtttcagtagcgcagaattattcggatattttaaaattaaataaaatgccacttacattaggacaaaaaattataaaatacagataaatctgacaaaagacatttataatgaaattacaaaatattggtgagagaaattaataagctttgtcatatactctgcatcatacacaaatacacaaatattaagtcaaaatagcacatttaaatgtgtgaactctgaaagggtcaatccttcaagaggaatcctgagtggctaagtggaactaaatttgaaatacagtcaagcagccatttggtaattagaggttacacacatactgagtgttcagggaaaaatgccatactcactaaactttgggactttcatagttgtctgttctgtgtatgctacctgaatcaatcaatagactgtgatctgtgccgaaccatcagaactcaacaagtttcaaacaatcagaactaactgagtttgcatccctcatttgtacaagcagatcagagtgggaacctgggcgagaacttttgccataaaagacaaactttctcttcattctcttagaacacacctttgttttgtacagaaggctgcattttcctggtgtacaaactgttagctggcataaagcctctttcctttttggaagaaaatccttttcagtggatttgttgataaatgtgaaacttaaaactataaaacttctagaagatatgagcaaaacaacatgacaatgggacagtttttttttaagatacaacaccaaaaccgagatccataaaagaattgataaatgtggatgtcatcaaaataaaacttgagcttttcaaaaacactcttaagagaatgaaaatacagccacagatcgaggatttgtttccagaacatataaataagaactctgaaaactcaagagtaagaaaacaatccaattaaaaaaactcacaagaacatttgaaaagacatttcaccaaagataaatggactgacaagatcacgaaaagattacagaaatacaaattaagaccaaattgagatattactattattaaaatatttaagattttaaaagactgattatacgaaatatttgtgagaatgttgaaaatttaggattctcatatcctgctggtgagaacgtaaaatgatacaatcagtttgggaaacagtttgtcagtttcttaaaaagttaaacaagcatattcaaccattccaccactaaacatttacacaagagaaaaaaaaagcacacattcatgcaaggacttgtacacacatgttcacagtacatttaattgtaacagatgaaacagagaagcacctaaatgtttacgaaaggagtggataaacaaattctgtatatcattacaatggaatactactcagcaacagaaagaaaggaataagctattaatacatgccacaacctagatgaatctcaaaataattatgctgaatgaaaaaagcagaagaaatatttgaagtaataatgactcagagtttcccccaaatgaacgtcagataacaaaccacagatccaggagaacactaacaggaaaaatatcccccaaaatatatcaaggcatatcatatttaaattgcagaaaatcaaagataaatacaactctgaaagtagccagaggaaaaaactttacccacacaggggctaagataataattatgtctgactacgcctcaggagccatgaaagcaagaaaagagtccggagaaatatttaaagcattgacagaaaaaaaaataccaccaacctagaattctggtaccctgggaattgcctcaaaagtaaagaataaatactttctcagacaaacaaaaattgagagaatttgtcagctgaacttctctctcagaagaaaaatgttatagtcagaaactcagatctacataaaaaaggaagagcatcaaagaaggagtaagttaaataaaaacattttatttgaattgatctaacagacaatagtttgttcaaaataatggcagcaatataatgacaaatgctcacatatatgtgctcatgtatgcttatatgtaagtgtaaggaatgacagcagtgatacaaggaatgataaggaggaattaggattcttttgttgttagatcctcatactacctgtcaagtggtatagtgttatttgacagctagatgtccattagattaatatgcatattgtagactgtaagacatttacttaaaaaaaaaagaggtataactgatatcctaagaaaggagagaaaatataatcacatgaaatgctcaattaaaaccacagaaggcagaagaagaatggacgaccaatggtaacaaatacaaaacagtaacaaaaatgataaacagtaatccacctataacaagaatcactctgaatgtcaatggtctaaaaacaccaattaaaagacaaaaattgtcagactcgatcaaaaaacaatatccaagtatatattgtctgtaaaaaaccttttaaaatataaagatgcaaatagtaggctaaaagtaaatgaatggagaggattctgagaatacagcagagtaggaagcaccaggaatctgtctccccaactagaaaacaattccactggcagaatctgtccaatataactattttggaactctgtcatataatgaagccttgctactttcaaggaaagactcagaggggtaaattatgatttactgtggtcatggtaaattgcaattaattttggtcaatttcagttctaagcacagtagcagctacccataacccacatctcagccccatggcaggtacctgtgcccaaactatgaaactataaaaatgcaaaactataaaactcctggaagataaaatagaaaatccagatgatcttgggtttggggatgaccttttagatacaataccaaaggcatgttcaatgaagaagaatcgataagctgtgacttcgttaaaattcaaaagttctgctccgcaaaagacattgcctaagaatgaaaaggcagcctgggagaaaatatttccaaaagacctatcagataaagaactgttatccaaaatctacaaagaaatcccaaaacctaaccagaagaacacaaacctgtttaaaaaacggaccaaggactttaacagacatttcaccaaagaagatatacagatggcaaataagcatatgaaaagatactccacatcatgtcatcagggaattgcaaatcaaaacaacaataagacaccactacgcacctattagaatggtcaaaatccagaacactgataacaccaaatgctggcaaggatatgaaacaatagagactctcatttatacctgctatgagtgcacactggtaaacagccactttgacaggttttttaacaaaactaaacatactcttaccttatgatcctgcaatcatgttatttgattttacccaaagaagctgaaaatatacgtcccaacaaaaacttgcacgtggaagtttatagtagctttattcataactgccaaaacttggaagcaaccaagatgcccttaagtaggtgaatggataaactgtggtacattcagataatggattaaaaagaaatgagctaccaagccattaaaaaaacatagaagaaatgtaaatgcatactgctaagtgaaagacgccaacctgaaaagggtacatactatatgattccaactatatgacattttggaaaaggcaaaactatggagacaatgtaaaaaaaattaccagggactggggggaagaacgaatagagggtgcacagaggatacggcagtgaaactactctgtatgaaactataatgctggatacatgtcattatatacttgtccaaactcattcaatgtataataccaggagtgaaccctaatgtaaactctggtttttgagccataatgatatgtattaatgtaggtacatcaattttaacaaatgtaccactctaatgggaaatgttgataatgggaaggctattcatttgtggtggcagtaaagtgtatgagaaatgtctgtatcttcctctcaacactgttgtgaatttaaaactgctctacaacataaaatctattacaaaaaaaaagccagaccaaaaaaatgacatattgtgtaattccatttatataacactctaggaaaaaacaaaatgtacaaaccaggttagtaattaccagggagaggagggaggaagggatttccaaggggcaaatggagtcctttgggagccatagaaatgttaactatcttgactgtggtgatggtttcataggtgtatgcatgtatcaaaacttatgaaattttacactttatatatatgcagtttattatacatcgattgtatctcaataaaagtttaaaaaaatagtctgaggcactagctgagaactttcagaccaaagttacttcatttcagtatgaaatttaggacataatttatcatatttttgctataccatataactatcaacatctgtataagtaaccatcagcattacttctgagtatgcaagtattgatacttgagctttatagaaaatgccagtatttaccgtccaccaattcatataaacatatgcactaaaattgctttaaatactgaacctagaggaaaggtagtctatgaagttaataatatatttaataacagataataaatacatttaaaattttttgcttgtccatttaagtagaatttttgttaacttgatgaaaagatctcatttattaccaatgaagagggttaataataacccaaatgccctctaagagggaactagttctgctagttaaataaattatgctatgaaataaattataaagaatgaggaaagtctctatagactaatatggactgactcctaaaatacactgggaatgaaaaaggaaaatgcagaactcatgtataacatgcttactaaaaataaatacctgagtggaatacaaatttctgtattttgaacctccaaaaactgctggttccagtggataataccttctttgtttcaggaccatcagagtaatcatttagtcatagtgacataggacatatacttggttatggatcttgggagaaacctcaacattgacgaagataatttacaaatttgaaactggaatctagaggcactggccacaaagagctggagggaggtgtcatttctctcctgggagaaagctgagttggttcttctcccatgcctgcccccaccttcactccacgttccatacaagccagctgaaagctgggtagatacacctgagatagggatggagggttgtgggctccaacactagttactgtgaatagctataagaaaagaccatgtacacacatatggttttaggacagagagtgcacacagcctcaagtaatgagtgaagagattttttaagagctcagaaacatcaacagcttggtgtactgacagtcagcagaagcaacatgtggccactaagaaagacttgttcaagattagactgcttcttgctaattttcagaaaagactgtatttgctgagcacttcatgtgaaaaatgtaaaatgaacatcatttcaatgatttcagaaagcggttttgaaaacaagggataataatttggaggactacttttgcaattcatttttgaataataaagtatatctaaattcagaagccaataagcagaatatacaaggtaacactttcaaaaatattaagttatatgctacatctaagatctaccgcttagctcttaaatcagctctttagagtttaaaaagggttgctcataatctcagccttcctatgtttaaacactaaaaacagtttggctggatccttgtgtaatactactttgacatttttatctaccaaaaaaatatggcactaaagaaggcttgtgtcttatttgtctcatcacttgtttgcaatgataaaatgtaacagcacttggtattataaaaattaggattatctttgtatcacagcttaaaaggcaggagttcatagggcacagacataactattttagagagaaacatccattttccaactattattgctttatagtactatttggcagaagaaaaaatatttctctctcaacaatatgctttatttctccagttactattaagtcggacatgggttcaaattcccattctgctatactgattctgcagacggttaatttttgtgaattttagtagaaatgttaacctgtcaattttataaaactgttgtacaagttaaattgagtaatacaaaatggcttatgcctatgtctgtctcaaaagtaaagttctacaattaacaccaattttaatactcttaataaaaaattaatatttgtagaaaataattttcttataaagaagaatcaaagttttcctctaaaatgtggtatcattaatatttcagattaacctatttgggttctacaacatggcattaagttctagtaaatcttagggaaaggcatttattattttggtcacgaaaatctagaaacacaaatgaaagcttttgggcaaaagcaggaggtcactgaaagtcatttagaatttttagagtgtcctgaatttggagtggggaaagactgtgaagatcattaatgtaaccctacacatttacccccccaaaaaaaaagaagagtgagggctgaagttaacaggattcactcaacttgtatagccaataaggctaagaagatatgaaaatctaggtctttcaacttagagtccaactgttcttcacattctatgtaccactctgcttttaaaacattttgattgcatttcacccttttatggtttacagtgcttcttccacatccaggtgacttatttttccaaaattttgctatttcaacagtttttaggcaactaataaccgtccagttaggttcctatccaaacaactattttccctttcttccttcctatgaaaatcctgatttactcctgaatatggcaatatattcaataaagtccactgaagccctattcctgctccaggggatgaaccaggtgatgaaccaagactgatctagcaaaaagcgaaccccattctgctttgctggtgaattagtttagagtagtcttgtaaccaatggaaccttaggaaggaattttgtggggactttcgaagagaggttttctcctttttttaaaaaaaaaagaaaagaaaagaaaagaaaatgtacaggagagtctcttttccaatgtctttggttgtctcccataagtacatgatacagcagtcatctctttattatgagaaagccaagagtttcacagagaagctcacccagagctctgacattgctgttttaaacaaccccaaattaccatgctctagattaaattattacacaagcaaaaaacctctatttattcaggtagtcaattattatatctgtggccaaaatctgccaaatataaaactctagtatttgctagtgaaactatgttacatgacttctagaagacttcatgtcataccaaataatatgaatatataattttttaaaattaaagtttgttaaaaatctattagggaaacaaaaagttgacttaaaaaaatacaattgacaaatctttagccagactaagaaaaaaagagaagaagatccaaataaaatcagaaatgaaaaaggagacattacaacttacacagaaattacgacttacacagacattatgacttatgcagaaatccaaaggcttgttagtggttactgtaagcaactatatatgctgataaactggaaaatatagaagaaatggacacattcctagacatatacaacctaccaagattgaaacaagaggaaatccaaaaccagaacagaccagtaacaagtaatgagatcaaagctgtaataaaaagtcttctagtaatgaaaaggccaggacataatggcttcactgctgaattctaccaaacatttaaagaagaactaataccaatcctactcaaaatattctaaaaaatagaggagggaatacttccaaattcattcaaggccagtattaccctgataccaaaaccagacaaagacacatcaaaaaaagaaaactacaggccagtatcgctgatgagtattaatgcagaaatcctcaacaaaatactagcacaactgaattcaacaatatattagaaagatcattcatcatgatcaagtgggatttatctgtgggatgcaaggatggttcaaaacacaaaatcaattaacatgatatatcatatcaaaaaaataaagaataaccatatgatcatttcaactgatgttgaaaaaacatttgattaaaaaattcaatatcccttcatgataaaaaccctcaaaaaactggatatggaaggaacatatctcaacataataaaagccatatatgacagacccacagctagtatcatgctgaatgaggaaaaactgaaaatctttcctctaagacctgcaacacaaggatgcccactgtcaccactgttatttaacatagtactggaagtcctatctagctcaatcagacaagagaaagatatcaaaggcatacaaattgggaaggaagaagtcaaattatacctgtttgttggtgatataatcttatatttggaaaaacctaaacattccacaagaaaactagaactgataaattcagtaaagttccagaatacaaaatcaatgtacaaacatcactagcatttctatatgccaacagtgaacaatgtgaaaaagaaactaaaaagtaatcctgtttacaatagccatacataaaattaaatacttaggaattaaccaaagaagtaaaagatctctataatggaaacaataaaacacgaatgaagaaaattgaagaggacaccaaaaaatggaaaaatattccatgttcatggattgggatgaatcaacactgttaaaatgtcctggcaatctatagattcaatgcaatcccaatcaaaataccaatggaattcttcacaggaatagaaaaaatactaaaatttatatggaaccagaaaagacccagaatagccaaagccaccctaagcaaaaagaacaaaactggtggaatcccattatctaacttcaaattatgctacagacctatcgtaaccaaaacagcatggtactgtcacaaaaacagacacgtgtaccaatagaacagaacagagaacccaaaaccaaatccaaacacctacagcaaactcatttttgacaaaggtgccaagaacatacactgggaaaagacaagtctctttaataaatggtgctgggaaactggataaacacatgcaaaatcatgaaaccagacccctatctcttgccatatacaaaattcaaatcaaaatgcattaaatacttcaaactgaatctaatacaagaaaacactggggaaaatctccaggacattagtctgagcaaatatttcttgagcaatagcccacaagcacaggcaaccaaagcaaacatggacaaatgggatcacatcaagttaaaaagcttctgcacagcaaaggaagtaatcaacaaagtgaagagacaacccacagaacgagagaaaacatttgcaaactacccctctgacaggggactaataaccagaatataaggagctcaaacaactctacaggaaaaaacctaataatctgataaaaaatgggcaaaagatctgaatagacattcctcaaaagaagacacacaaatggtgaaaaggttctcaacatcactaatcatcagatatccaaaactcaatgagatatcatcttgtcccagttaaaatgccttttatccaaaagtcaggcagtaacaaatgctggtgaggatgtaaagaaaagggaacccttgttcaccattggtgggaatgtacaaccactacggagaacagtttggaggtcccccaaaaaactaaaaatagagctaccatatgatcgagcaattccactgctgggtatatatccaaaataaaggaaatcagtgtatcgaagagatctgcactcctatgtttgttgcagcactgtttacaatagctaacatttggaggcaacctaagtgtccatcaacagatgaatggataatgaaaatgtggtacatacacacaatggagtactcgtcagccataaaaaaacagacccagtcatttgcaacaacagggatagaattggagatcattatgttaaccgaaataaggcaggcacagaaaaacaaacatcacatgttctcacttacttgtgggatctgaacatcaaatcaactgaattcatggacataacagaaggatggttaccagaggctgggaagggtaatggggggttgagtgggaggtggggatggttaatgggtacaaaaaaatagaataagacctactatttgatagcacaatagggtgactatagtcaataataacttaattgtatattttaaaataacttaaataatgtaattggaatgtttgtaactcaaaggataaatgcttgaggggatgaatacctaattcttcatgatatgattatttcacattacatgcctgtaccaaaacatcccatgtaccccataaatatagacacctattatgtacccacaaattttttttaaaacccactaaaataagaagaaaaatctattaggtgtgttactaagaaacgtgctgtttagtggtctacaatattcaaaacctcagggtgtgactaaagaaactcatctaaaattatacaatgactatttaatggtagagaaataaatctgaacttatatccattctaaaaatgaataaaaacaacttcaaaaaacttaagagaaacctgagtttcaaaaagtccaacgttattctccaaatacttatttaaataaatttactttggaaaaacacgactgtcacactgacataaagcttaaaaatattttattacctattaaaagtcagtgcatttaacacccattgccttttaaaaccccatatgattccttatcagacaaaatcagatgatatttaccatcttaaattcaaataatggccaaaaagttaacaaatcttgactttaaggcaacactctcaactactaagaaagggtcacgagagaaaaggcctaaaagcaatcataaaagttgttgtcaaaaacctttgtatcactgaagacaattgtcaaagagttactctcaagaaaggcctactgatgagtgagctgatgctctcaatgactctgaatttttttttaatttaggataaattgattaaatataacataaaagtaatgtcagctacaataaactttgtaatgatggagaaattagccctggtaaatggaattatagttcaaactttctaatcaaggtagtatttgtcagtactattaaaataaaaccaaaataacaagaaaaccttaggagttaaatggaaaacatgttttccaccttttcatgcgtctataccccttgagctattttctaagaaacgcatactcttcagtataccctgggtaaagtagccagacacttcatttaaaacaaataaatcatggcccggcacagtgcctcacgcctgtaatcccagcactttgggaggccaaggcgggccgatcacctgagatcaggagtttgagaccagcctggccaacatggtgaatgaaaccctgtctctactaaaaacacaaaaattaatcgggcgtggtggcaggtgcctgtaatcccagctacttgggaggttgaggcaggagaatcgcttgaacccgggaggcagaggttgcagtgagcggagatcatgccactacactccagcctgggcaacagagccagactctgtctctaaataaatacatacatacatacatacataaatcctgaattaggtgcatgtttccaactaaatataaacttgaaggcaattcacttagaaaaaattttaaaaaatatataatgatagcattctgttcattacccaatgttaaaattaacaacagttttagccaatgattcaaatctattcagataattcattattttaaaaataaggtaaaacttttttgtatctacctaacattaagtggtcacagcagtattatattaaaaaaaaaaggaggaaagatgagagttaaaaatgagcttgcaatgggtgctttcttaaaaccacaatcatttctaggtcatctgttttggtgttgccacagcgactttgtgaatcatatgacttttcaccccctccataactcaggggtacatttgtttctggtaaaaatatatacattagtggatgtaattttgttagagtacgtaatgtactttcagccacaacttagtaaactaaatactggccactgaaaaaacataacagagagagaaaattatccatatatccacctttctaaaactgtccatcatgtcagcactgaatatactactgtatcgttaagtctgaaaacttttccaacaatgactttactgaaaacctaatctgacaaaaattaatcaagcaccattgtaaaacactcaccatgattatttacaaaaagcaaatctgatcttatatttagatatacacttacaagaatcctcatttgaaatgcacagttaagtatttaatggtgaagtatcatgatttctgcaacttactacatatatatgtaaaagttgtatattaataaatacagaaagcaaatgtggcaaaatgttatcaatgccaaaagtaagtgaaaggtatatgggtagtcagcatgtttttttaacttccctatgtttgaaaaatttcaaagtaaaaagctgggagaacaaaagacccctactggctgctactgccctgagtatatgtccagtgttttcccttttgcctcaataccttcctgccctcatttaaaacaactgttacagagttatattatgtcttgtaaacaaaaatcacaattctaggaaagaattttaaaaagcagttttaaaggctggcatcagtgaattaactgttttacctgaaagttaacatcttctttcttaaatattagtgctcgaacttcatcaggatctccgttaaatatagcttgcaccagtgatggctaaaatagaagagagtaataaaaacattagaatcatccatgtggggtgactaaggatattttacatagttctggaatctacaagttttcttccctgtagcaataatcacttttgacattagccagaagtttcataaaaccaaatcatgtcaaagtacaggattcctacttggaaaaaaaaggcctaattaaaaaaaaaaatcaattcagtttgacccaatttaggtagtataataaacaaaatcagattttatttcttgtaagtagaagccttttgtttctgtatatgacaaaaagaaagactcttccaaatacaaatgtgtgatctcaacatctacttgtgggacagaactttttaagcaatttccagcccatgaaggaaggcttttttgaaaaggtctgtttggggcatcaaattatcttacatggattagcattacatgtataaagatacaaatcccaagaaagcaaacctggcagttgatgaaaatagccactaatcaaagaccaaaaaatactggatacttaaataacttgaaaagacaaacacatgcataactaaatataataatttcttaatcaacgatacagcctcttgataaggtatactatactagtcaaggagccagctgacagtagcactaaaaccaaggttaaagatgaagactgaatctcatataaagtcttatatgtaaatacataaaattcattacagaaaaggccatgccttagtgttgctgggggtagtcaacctttcctaaaatatgcagagttcctgattcttgttacatcagtttctgaaaccacaaaatgaaaacagaaacgtggttgccataactactaattctcaaattatttttaaacagtcttttaaagagattaagacatagtaaagactgaaatgttatctcagcattcaaaaaagtaaaaacgaaaaatgtgcattttatacaaaaatactgcatcatatctacacacgtattgctttaatttgggtttgtaaagaaactattggaaatttacatctattcttaaaaaacaagatttatactactagttcagtagaatatagtaaacatataaacttacatatcttaccaatacatttccagaaggtggagaatgtagggatttattttcctgtggcaatttagaaatgaatgcaggagattcatcttctacctcctccaaaacaacaatacacactcgactcattcgatcttttaaaacactaaattccaagctatgtgataaaagtcacagttggaagagcacaagtagtttttcctcctcttctgtacaacacttacaaacattctctgaacagcacagctgggttttttttttttttaaagttaataagtactactggaaaaacaagtttaaaattatgactacataatttgtaacttcctaaatataacgaaattctattatttctgttggattactgcaatacttaagaagaaatttcacaccaacatgtcaataactaaaactgagtccaagctcatttaaaaatatttttcctctaccaaaatagtcttattgctctatctctgaaatttacttgcacaaaacaatcattgtttttggtgacacaacaccacacaatatagaatgaaatgagaaacaactgctgtgacagagatgatcacagcgatacccactcttgcctgcaaggtcatatagttaccagtagctgttttgcttataattgaaaataaaaaataaaatctcactattctgtttccacttctaatttgtcttcatttcttcatcactggtttaatgcagatactattcacagaaaaaagatctagagctcagcacaaatcctgaaaatgaagctcagaggttaacaattctttcagtgtttgggaaaggggcaaaaaacaaaaacaaaaaaaaaaaaaccactctgcattaatagcaaagctgcagtacgtttacatgtgatgagtcagaccacaagagacaatacgactcttggtactagaatacagcttgattaatccaggtttcccatataatagaagaaacacagttagctttattcccatcgatagcataagcaaggcagagcgttcattctttctccatcaggcagttgtctgtggctgctccagcaaaagggcacaggcaccaggcagaaatggtgttagtggagaatcctagtagaacaagcaggctgtgaaggaattagaaggcatttgagctcaaattactgcttcaggctttttgttttctttaaaaaaaaaaaggggggggaaaaacatagtagtgtatcattccagtgtttcctttgatctccacatgaatacagcttccattaaacagtcttcattcagagaaaaaaatagcagactgtgcatcttctttgagccaactactttattcagtcatctgcctctttgccaatatagtttccttccactgtgaaaaccgccacagttatccttttcagatttcaaatgctttcctgttcctcagatgatcttgcaaaacaccactgacatccccaaatgagtaggtccttaaaaaatatctatagaacctcagtatcagtcccacagaagcattccaacggagcaacagtctgaagagcaaagactgcagacccacaggatgaaatgcctagtaatgctcacatgttacacttaccagagatctgagctacttctcgggatgtaacttcctctagcaggagaaaaaaatagtgcatttggacagccttcacaattagaaggttcatgccagttctgtgactaatccaaatcaaactaaaaaattctataactgaaaaatgagtgcgcttttaacattttccactaaaagccacaaggaaatctggtgtactgcctctgctgactaacagtggttttagcaagtaaacaattccaaacggcttaactgctttcgtgtgttacaataaagcaaatgtttaaccctataatgacagttgcagtaagaatatgcctgcaatggactcataaaaaaggtttaaagatggagaaatattttattagattataaaaaccatgaaattgttttattcatatttttaccaagatcagttttaatctgccaggtgtattttattttctagaatgcaaagcttaaacaaatgaaatttaagattgtctaacaatttctaaattggtgaatttaatcaatcattgattcatattttaaagggaaaagcaaaaatttcataatgtagaaatcctaactctaaaattatataaatcatttgatttttcactgaagaaataaaataatcctaccttcccatttggatagggaataaagccttaaaaatctgttaaagaggtacatgaaaaaaaaaatgtccttcgtcctgaattacctatgtcaaaagggcacagggtaatacaaataatctccctccctataaatttcccaaagccataaataaatgtcaaagccaatcatttcatcgttttttttcttctttctctgtttacccaacatgggggatatttctcaagagaaaacttacaaagaaaataccatggtcccccttcaatctgtgttcttcatattaactagcatttttattaataaacaataataaacataatagttacttttgaacatctgtgatatgctatgtgctgtacattctcatttaatacaataaccttgctgtattcccattatagagggaaaaacagactcagaaatgatgtattttacccaaagttgtataaattaataaagttgtgtgttattttaaacacatactctttctaatctattctgctatcactgagtacacacacatacagacacactctcttctctccactcatctccagatctttgcaacctgtaatactagcttataaaagtgatcttaacaaacaggtaacctataaaggttgtgaaaagtttaggtaacaaaggaatatactatttattgctatattctaaaacgagttatttttaaatgggtacttcaaagcaagtcttaaaaccataaaaaggaaaaaaaaaacaaaaaatcccagcatgatacaaatataagaatgtcagaatttaaaacaagaaccattgaaagctataaaatgtatcaatctatggaagaagcaataactctaacatatttgtaccaattaaaacatgctaacaattcattagttatattttaaaatatataaaatacttttatgccaaattaaaggtatgtaaatattgaacatacatcaattatgttatccatctccacatagctgaatcaaaaaatcttaatatttgaaatatctgaaagtgaaacaactatagtaacaatatcctatatttcatcttcagggttcccaagcccacaaagcaaaatctctttttatcttaacaatcttaacttgttccaaagtatctagtacctaagttcacctacttagacttaagcaggtacatcctgtttcttgttctaagtcaacctccacacttaggtctttcccaaccagaaaacaaactccttgaaggtagggactgtgttcatacatattgtctccttccactttcttccacctataaataatttcattgaaatgaattctgtcgtcacgagactctggaagggtggagatttataaacaagaatagtgggggtgtgttggtatacatatattttaaccagaaaatataggtggcattaaggtgcaacaaagtgagtttcatatctctaataagtgaacaattaaaatttcagaagttgacaggatataaaacaaaggtatggggtgatggttaaaactaagggctcaggagtcagcccacctgaagttcaattctgcttccatcatttcctagctgtgtccttggacaaaccacttaaattccctaagcctaaatttcttgacacttatataagaaaaaaataacctgcaaagatttttgtctaagagaaatagagtaacagtacagtgcttgagaatgtaggctattttgtggtcaaattgcctgaagttctaatccaggcttcccactaacctaattctgggatcctgggctactcacttatttagtaacctctctgtgctcattttaacatctattaaatgacattaacagaatttacttcatagtgttgtgaaatctaaacaagataaccttactgttatggatatttgggatagctgaatgatatcccttgtgaagccagtgagtggatcaaaggctattaaactcctcctcctcttgacccagtacaagtgaggtaattcagattaatgtctggagatcccattcagttgccaagtccccacacttttcagtgatctcttgagagtctgctaaaagctcattttagactctagtaactagacaagcacatactaagtgttaattggggagagggagcagtaaacttaggcaagaaagactacaggttcttccattcttctaccttcactagattttacagtttagggactgtaaaattcctttgggaaaaaggatagaaagtactagcccatggtatattataaaatcaaaagcagataaaaaatactaagagaaatatgtcagtttttaaattatttaaattagcagcactgttttgtgtcttcttctattgaataagacaggctcctaccctcaaggaactcacatcttaaaaggagacaagtgaatatttaagaacttagaaacagagaaagtacttctgataaaaaactgctgataaagattgtgcaaactgtaagttcaacatttttttccacttagagaaatatcaaggggatgtggttattttctttggtacttattttttaggccatattagattaagtttttaataagctaacaagttcaactctgacagctttataatccttctattctttatactaaaatgtatcctattaagagcttactcctactattaatggaatcacataatggtaaagctggcttaaacctttttactgattataaaaacattaagtcactggaagataatttttgggttcctaattgttacacctgaatttctttttttgacacaaacgatttttcctttctgcaacaagatccaacctaaacctcaccttttgtcttacacatctgtgaactccgtattatcatagaatagaatactcagggtatattaagtggctactctgtggcaagtaacaagctggtctctgagtatttgaaaataaaaagcttgtggtgaaagatggtaaggaagtgggttcaaacaatgttatagaaaacatttctgacagatcaagaatcctcaccaatcttcttgagctacgcctcatctatccatatactttaggaaaaaaaagtcttatgaacagagttaaaagaaaatgaggtagagggtgagtggggagaaatcaaggaatagctgctttctaggctacacaggccagaatccatgcaattatctatgtgattattagagccactgcaagaaagtcactaggtattcaaaacacaactcaaaatcctcataatagatcagacttaactctctgcaggtaatatatttatgatccaggacacttattttttatgcagtcataatgccaaaatggccattaaccaatatcgtttgacgatctcaagtggtgtgatcccactggtacgttacattcgtaataataaattgttaacccttccaatattaatagtactgtatactgcagattgttagcacattctaatattacatgtgttttctgcagagatctgtattttgtgtccattcctccaggcttccatttcagctttaggtaagtacagagcctcacacaataaagactacatttctcagctctcttgtagctaggagccacatgaaaaagtttgaccaaaattttaagtaggtgttgtgtgcctttcagaaaactttcttaaagaccaactagcatattcagcttgcttcctggaacaaagatgattggccactatcttaaaccaaacaaggaccatagtctagggtagtgaaactacactagaagggagctgggtctttgaggactttgccaaacagaactgccatacaagccttggactgtctactttctgacttttatgttagagagaaataaaaagtcctgccttgtttaagaaactgtaattttgcatctctggtacttggagctgagcctaactctaaatgataatcttactcttcctttaattatctatgagtggacatatatccttcgagccctgttcttccaacatccatactccagtacaatgtggctacttaaatcttcaataaataaaatgagttagaaacttgagctgtaacatattgtactagaaacaataatcagaaatctgctggaaaataattcatattttcctggataagctaaggacaatcagaggagagagaaagagatggaaacagttaccacaaatattctcaatcatcttcagccaccattttggtgggtactgttatcaaatctctaaatgagaaacaggctcagtaacatctagtcagccaatcacttatctgccccatccattcacctagtatacattcatctactatgtgccagtctttctgccaagctgagaaaacaaaattatgaatagtcaatccttgttctaatgaaccatacacacaaataaatactatatgactgcaactgtgataaattctcgaataaaaaaaaatgtctgaaagacaaggaactaatgggtggcccatgtggctggggaagcaatcatgagggacaatatcacatgcagttggagaagtgggtatggtcatgtgatagagaggccttgtaaaccaagttataaagtttgtatttttcatcaattgagaactcattaaaaatttttaattaaggaagtcatgatttgcttttgctttaaaaacattatgtggctttgatacgaagaacggattaaaggggtagaagaatggaagtcaaaggactagttaggagaccactgcagtaatccaacagagtgggtgatctgaattaggacatgatcatataggtggagagacagaaatatattttagaggccgtgcacggtggctcacacctgtaatcccagcactttgggagaccaacgtgggcggatcatgaggtcaggagtttgagaccagcctgaccaacatggtgaaaccccgtctctattaaaaatacaaaaattagctgggtgtggtggcgcgtgcctgtaatcccagctactcaagaggctgaggcaggagaatcgcttgaacctgggaggtggaggctgtaatgagctgagatcacaccacggcactccagcctggcgacagagcgagactccatttaaaaaaaaaaaaaaaaagaaatatattttagaaataggatttataggacatgttaatagactggctacaagagtgatggagaagatgataatcagaaacctcccaggtttttgacttaagcaaccagtgcttattggagtttaagaaatttgggacttttttagtttccaaatttatacaatgaagaatgttacttgttacatcaatatctaaggtgcatttcatgctctcaaactctgttttaaacttaatacagagcccattatcttagcatctaccctcatgacttctaaatgaaatgttaaatcccaaagttgcctacatctaggtgaatattaaaaaaattcataaagaatggtgagatctggctcaattctactcaatccagtacactgaaattatctaaaagtcttttggcaagaataccttactttttaaaacactcaacaaaaataccacagcactgattaaacaattattagacattcatatctctactatacataccatgccaaggaattataaggtatcatatatcaccttcaaactccttatgcaacttaaatagggcattatgtcatacacgtaaaaatctaaccagtacaagataaaagacagtaaaagacagtatatactgaaggccgagatatagactatacctgctaccaagtccatcataggaaagagtgtagcatatgaagttattaattgtaactgacatatacagataccttctaactgtccattctctaaaaaaatggatattttaataaaactctccataaacctcattattttgctcctcctttaatttataggaagggtgctttgtcaaagaaatcaatggtctgctagttagaacattccatgtaaaaactctatcacatttttcagaaaatggttgaagattcaaaactatcatttataatatataattgttaaaagtgagtataagtgactgttgagcagttaaaagcaatggctcacggtgtccaggatagataagaacaaacatacagaagcaaaggtaattacagcaaatgagacaagttgtaggatgtggtcattgaggtggttacagccaagtggaggtggttacagccaagtacagatgactgctggtgtggaggttgttaaatagttaagtatgttcaaaatgtcatctacaaagaaatgaaatcacctagatgacagacaaacatgatccagatgtggaactggggtatgagatgtgacagatgatagcaacaagaaatagaaggatcacctagccaaatggtatgtgcctcaaaggaaggaaggtttttatagacaggcagactagtaacattttaacactataatgggggactagaagaatgctgactttgcgctctttcctcctcccaacacacatgtacttacgtagcaggtacttacgaaaacagagtttcactgacttttccaagtaagtgtagattcaacagttacacatatgaacttaaggtttaaatcaatatttagatgactatttttagatttcagccttaagagaattacttccttccaaaagaatataagtaaaaaattcaacaggccaaactaacacaggttagttttctagaatacacctaatatgccaaaactaaggaacaaagggagaaaaactactctgttagcaagtatgtagtactgcatttaagtaatgtctttaaaagttaggttattttcttcataattttgattaccttgagaagcagtttgaaattaaggaaaaggactcatcattttagaggtcttttttttaaagttgtgatactttttaaaatatcctagtcaatctgattagtaaaatttttagctaagatatgtgatgagtagtatctctgacatatgacttatgttctatcaggccaaggataaacacattctctgaaatctacattattatttgcaaagttaattattgttcagcaactgtatcaaagacaatttagccctcatattaaaatcagttgagtgcaaaatttttattttaaacaggctgaattttgcccttcttaaaaaaagattgaggaaagattatgtgcaattcattctggtttttacaatgtggtgatgccagagtaaatgtagtatgaagttaatgcactttaaaagctgaagggagaaaattttcagttttaaaataagttgctatggttacaaaatgtttacctttataagcaataattatgtgagatgtccaaggaattcccgaaagtacagtaagatcagtatctgaagtgtacattcgttatttcacaaacaaactgaacccaactgcatacatcacttccgtttcaaagtggctatcgtttgggaaatactaaaaaaaaaatgattcatgtctttctgaaccatattggagacaaaaatactgaccatagctatttttaaattcaagtaatgactcagagagttttagttccttttatcaaagagtgctgtaattttacatagcaccttctattgttgaaagaaggaaggtatgtttgtaatgtgtctcaggtgtggagtttcttttatacataaattttcacgccttcgataaacttttaaaaagccatgcttgtaacaatgttaattcagagtaaaacgatgtcaactcctttagctgtagacaattttgaacttcttaaatgggaagaagaggcccctataagaattgataattagcccattcctaactaggttgttaaatccgctatcagttactgtattgtagaaattttttgtgtgtctgtgttttacatttagaacattcagttttgtaagactacttataaaactttcaaccccatatagctgatcttaaaattagacgctcatcattacctcttagaaggcagctatgctcaccactataccaacactgctgccatcatcacatctttttttttttttgagacagagtctcactctgtcacccaggctggagtgcagtggcacaatcccagctcactgcaacctccacctcctgggttcaagtgattctcctgcctcagcctcccgagtagctgggattacaggcgcatgccaccacgcccagctaatttttgtatttttagtaaagacagcgttttaccattttggccaggctgctcttgaactcctgacctcaggtgattcgcccacctcggactcccaaagtgttaggattacaggcatgagccaccatgtccggcccatcatgacatcttaatgggccttccaccagtgtctactttctatgtaatagaatattaaacacatttgttaatattaggcctatcctaagccaaaaataatttataaaataagatgttactctcaactggcttaaacaaagggattatcatcacaaacatcaagaattaaaataaggtggctttagggtgactgattcagttatccaatgccatcatatatgacctacgctcctttcagcttttccctctgtcagactcagcaagaaccttaggataactcccttcatagccacatgttaattgttatacttcatgggatcctattaaacacatattgtcatgcagtagaagtggaaatatccttccgtgtctcccttttcaggtatgaggaagactcctagaagccccacaagctgactttccctgaaatgcaaagggccaggctttgatcacatgtcccttcccaaatgaatcactactaggcagaataggattaccctgattagcttgtaatattcgggatttccccaagcgatgtgggatagacgtggacatacaaacaaaattgggggtaagcatgcaagaaggaagagggtaattgcaaggaaatcattttataaatgccatggacatacaagaaaaatgtcaaacataagaaaacagaatactttaggatgaaatagtaaaatacaccttaattttgacctgttaaaatgagagttttatctccaaaatgtttcctattaatctcatcttccttctctatgaaaagcaaggctaattactagacactgggcagactaccactagagcaatgaaactagaataccttcaagaagggcagccagtataatgcataatctagaaaccatttcataaagggttgataaagctgaagatattgtctgaaaaggaatcagggagaacatgaaaactttaaaatatttgaagtactgtcactgtgaagacaattacacagttttagagataagctaaatcgatgaataataaacaggaagatgaaatgtttcaatataagataatacttttatctggcatttttcagtctgaaggcataataaggttggctactcatatggggcagggataaacatcccaggtaacttgaatagctactatggttgtaggcactttatgtacattcacttaattctaacaacatgcctgcaaactagtttttaaatcccaatttcacggacaaaaaatctgagttggaccaattaaacactggaaatcacaaggctaagcagtagggaaaactggattctaacccagacccatctgtctccgaagcttggctcttcccacacaccagacacctaagagaagttaaattagcagttgttaaggaagcaaatggggtttttgagctggtgagaaccaaatatcaacggatttgaagtcctattcaaaattaagatgccagaaatgaagtattacttccttccatttgaccaataccttctagtttaacaatgtttcacatcgatcttcccactggttcctcacagcaatgctttaaggtaagttggagaaaggccttatcccctggctttctacctcagagaggaaaaaagaaaacaaagatgaatcctatcaacttccctctgctttgtctccaagcatatttgtattttcaactttttctctatgatctttcatttattcaatagtcatctttcatttattaagtacttcttacatctcaggcatcaaatcttcaagactttgcagtctaatgggaagaccttgtagttgcagaggaaaaggttcattcaagactgtatctatcttctaatagaccttactttttcaattctgattcctttcttacagctttggtttaaccttctgttcctttattttggcctatagaaagctttcctgcctcttcaccaagctaccactccttttgtttgtttgtttgtttttaattgtttcgacccactgcaatctagctttccaccaatcaaatgaaattgctccaaggtcatcaatgataatttattacaaaatcatcattattctcaactactctacaatattgggcaataacctctcttcttgttgcgtccataatatttttacctatttttctggtcccttttctggtccttttcacttggtttttcttctacacacaccccccttttttttttctagctccttttaatctctttttggacaatctcatgtcaaaattctacttatcatctgcagtccacttccccaaagtgttctttttctgaattcccatgttggttaatagtaatggcatcaccatgtacaaagtagcccaacacacagtagccttcccttacttcatctcccacttttagtcagtcaccaagttctatgcattttacataaagttttcctaaactctgtcttcacagtgacctaattcaaacccacttcagtcctcacctaagctatcataactacctcctaactagcctctcaactgttgactctccttctagttctatacatccttgtaacagacacaggtactttcacacagatcctttcctttaaggagagtctctggtcctgagacatacaagaaacccaagcctgaccagagtactacccacccctaacaacatgtctcgttcaggaaagagcacatgactgaaactagacaatgtcttcctcaggacttcactttcctgccaaggctatcagagaaaaatactctcttttctttcgggattgtgaggacacaatcccagtaagcaaaaactgctcataggaggaatgaaagaatgggggaggatgggaaacccactgtcaccaagtcctggatctagctctgcttgcctggccagtaaatatacttttgcatttaagccaatttgagttggatttctgtcatttgtaaccaaaagtcctgattaacaattatctacaccaccagttacttttctaaatcatagataaaatgttgtctacttttatttagtcaactattttgtttgagtatgctatactaaagacttccagcagcctgcctttaagtttcacatatatcaatgtgcttgttgcaattcaagtataccatgccactacatgcagctatgcccttgcagatgctgtttcctctgcctagcacatccccctcccacctcctcatccacaaaatgtataggtttgcataaaataaggtggaaaattagacagcagcgagatcatgaagggtgttgaatgacaccgagtaaatacactttaacctatagaattttaaggcaaaaagttataaaataagacttgtatcttaaagaacttactgtgcatacagtgtcaggatgacctaaaaataaggtgatactaaaggcagagaaaacagtcagtaggctatcacaattagtttaaaccagaggccatgtaggatggtgaaacagtaaactgggacaacttctctgggagaaaaaaaaaaaacttgccaacagctatcaataccattgataagtatttcaaactttaagctagcatttctacttgtaggaactgagacataagaaaataatgtgaggcctataaaaatttacatatcaagatttcagtgaagcattatttacaacaaaagactgaaaatttaaatgctgaacaataaaatgatttaaaatacagtatatatcacacagtgaaactatatctaatatttaaaaataaaatctttaaagaatttctaaaacatgggatatactaaaaaatattatatggaatacaacactgcagtataaacaaaataatcttaattacgttaaatagaagactttttttctttttcatttttagcatcaacactacatgagttaggtcagtggcaggattatgagtaatttgttctctccttttttttttttttcccctaagtaacattgtccttagccatgatccttatttgctaaacaaaatcacaactttataggtaagaaaaataaggcctagagtggttacatgacaaagttcacattctaagagttaagaccacaacttgaacactgcctatgtgaagactcactgccaagaagcaaacctgcaaagccagtcatttaacccataactcctgtaagcctgagactcaaaggcaaaccaagcctactgtgagtgactttaaacttgctgacctacaatcccctataaattcataactcaaaagctataaaatagcaaatgaagagcagactacagaacagggtagtttaagatgcttgtttttatgactttattttttatctaaataaccctacaaagaacagaaaaggaaataacagcacaccagactggagaaacaaggcctcagagtaagttgttaagggacactgttattctagagtctgttttattttgatctttaaaagaataagagaatgctttattagaagaaattatttccctgaattaagatctccataatctgttacaatcacaaatagactctatagacttaagtactcaactcatttaagtagggtagctaacaaaaagtcatttggtagctaaaaaagcagaatttgaaaatagtatttgtgaaataaaagggcttcagtgaaaggagtctgaacagctactggataggagaaaagacaaaataattaccagggacaatttttctttattttgagatagagtcttgctctgttgcccaggctggagtgcagtggcacaatctcaggtcactgcaacctctgtctcctgggttcaagcgattctcctgcctcagcctccagaggagctgggactgcaggtgcacgccaccatgcccagctaatttttgtatttttggtagagacggggtttcaccatgttggccaggatggtcttgatctcttgacctcgtgatccgcccaccttggcctcccaaagtactgggattacaggtgtgagccactgcgcctggccagggacaatttttttaaaacctttattttaaccttataaattaagaaattgtggttttctatagatgccatgtaaatgatagtaccacctaaaaagttaatacatttaaaatgtttctaagccaggcacagtggctcacgcctgtaatcccagcactttgggaggtcaaggtgggtggatcacttcagttaggagttcaagaccagtctggccaacacagcaaaaccctatctttactaaaaatagaaaaattagccaggcgtggtggtacgcacctgtagtcccagctactcaggaggctgaggtcggagaatcgcttgaacccaggaggctgaggttgcagtgagctgagattgaggcactgcactccagcctgggcaacagagtgagactctggcaaacaaaacaaaacaaaacaaaacgaaacccaaaacaacaataaaatgtttctaagatgataatcaaagatggcatcatagagctgggcacagcggtgtacacctgtagtcccagctacttgggaggctgagatgggaaactataccattatcttaatttcatttgttttttaaatgaattttcaaatggtgcccttaggtaaatttagaaagggtttgcagtaaccaatggaaaagcaccatccagtggtaaaagatgataattacaatttatacagttattaaaagcaaaattagctaaatgatttgtgactctgccttttctccaacacacattccaggaaagaaaaggtaaactggctatataatactgagggtatctgctatttgttaccattttcttaatcaaattttactatattaagttggcatttcgttgttgtttttctgtcttgcttaccaattatccaaatgctcgtttgggaacagaattaggataggggcattgttaaaattcatctaaagcctttattaagccacaggctagaaaatggtttaaaaagtgtgtgagggggtgaatttccaatggaactctagttaccaacagccatcccacagaacaacaaataagtcattctatgtacttttttaaaaggtgatcatgggtaggtaatctagaccctcctgaaaaggccaggtaaagattcacaatcagagatttcataaagaattcagaatttctaaaaggaacatgaatcctgaatgtgacccgattcactccaatttgaagaaaacaatcaggtaaacggtgtgttcccaataatctacccctatcctatcagaaaacagatgaataaaatctgcagtttccaacataacagctttttaatcacctccttttttttttttttttttagagaaaaaattaaaaagtttaatacaatggctcaggcctgtaatcctagcactttgggaggctgaggtgagcagttcacttttgagcccaggtgttcaagaccagtctgggcaacatggtacaaccccatctctactaaaaatacaaaaattaaccgggcatggtggcatgcacctgtagtcccagctactcgggaggctgaggtgggatgatcgcttgagcccggcaggttgaggctgcagtcagccctgatcacatgccgctgcactccagtctgggcaacagtgagaccttgttgcaaaggaaaaaacaaaaaccaaaaccccaaaactttaatgaaaccaaaaacaaattattacagaaacccagtaaggatgattctttgttctgaaacaactttacatcaagtctacttgatatcaaatggtattactgtttgggatcataagatatttaacaaaaagtacagcatactgcaccttggtaatgacaaaaaaatcaattactgggccataattttctccttttatactctaaaaaatatttcaatatgtttgaatctgacataagaagcctaacaaatactaccaatgatatcaaacaagcttatcctatcttcactagtgcctgcagtccaacacacctggaggttgtgagattttttaaaaactactttcatgaaaacataggagtcactcaaataattgaggttccccagtgattactgaatgactgttaatgtttaaagtgtgcagcacaatcatttaacatgtaagagaatgagctatgagcaaaaggatgcatacatctaaaccaaagtttgaaaacctttagtaatttagtatttcagaacaaaataaataaaactagttgcgataccattattttcagctgtttaacattttcttctccaagacagagatcttagatttataagccccctccactgaaaatttacttgaattataaaacggctatactaagtcttccactaacacagggtccactactataaatgtttctacaataaaggactttttggctgacactaactatttactcacatacagttatgtatgaaagctaagttacaaggaggcttaaacagcaacaaactaacaaattacaagagctgcctatattactgcaagagactactagaaaataacctaccataataggaattcccatactattttcctctggtggaggcagttgtactgtttcaattccaatcacaggcctgtagcagaaaacagatatcaaaagaaagaatacgctgatcctagaaattaagggctatgttatttataaataactagtaccttaacaaaacattgaattattggataatattcaaaaacttactttggattttattaattcagaatttacttttatccttctatcaagaaaaaaaatactaatctgggcaacaaaacattttttaaaggctttctttatatattaaacagaattggcttcccagaagagacttaaaaagtggtgtttgtttcttagaattcctagcaacaagtcattctcataaatcttaaacacaaacacacacacacacatatacacacacaaacttttcaaatgcattcactaataatatattcagttacttactaatcagcaattatttacccatggggacgtgttgatttaagaaactgcctatgaaaagtttaaaatattcaatctatacgctttttgaatatgtagaacatactcatttcagtaatacataaatttaagaaatcactgcaatatctctcaaagaaaactctggtaattttatacatatattatatataaaaagtatatatatatacttttttaaaggttaggataatacatacatattatttagtaacttgcttgtctccatcactcctcatttaacaatgtggaccttaaatattccgcaacaccctgaatatgacattccattcaaaaatactgtatttaatttcctaagagtaaatatttgggttgcttctattttaaaattcatatataataatttttctaagaatattatatattcttgtataatacttttcccaagataaaaaataaaattcccacaagttaattttagtgaaatggcttgtcttcacataaataaaattaggcctaaaaaattatggagccataattctcaagtgcaatgacctagaaagaacaaatgtcagaattacattccctacataaaagtgtggggccaaccacatttcttttgtttttcttttatgacaaaattttgccctgtcacccaggttggagtacagtggcccaaatgtagtttcaacctcctgggttcaaatgatcctcccacctcagcctcctcagtagctgcgaccacaggcatgcataacctcacccagttaattttttaatttgtttgtagagatggggtctcattatgttgcctaggctggtctcaaactcctgggctcaagcgatcctcctgccttggcctcccaaagtgctggggttacatgagtgagccactgcaccacccacacacttcttattgttctgaaagaatcgtcatcaatgctatgacaaagaatcatctttgttatagtaattactattgtagtaattaatgccttctaaaatgttagaagacataaactatccttggatagttggaggaaggtcagctatagttctaaacataaaaatctgttatttcttcccttgtcaaaattatttatgaacaaatcaacctcatcagaaaatattaaaggtacattattttaggttctacagcatgtaacagatatggtaatagaattagtctgccatatggtggcagcaaataccaaagaaaattaatttcttgagtacgtccatttaaaaagttaatgtcttccctgagtcatgtattttaaacaaaggtttcaaatagaagaggctttacaggttttcataattatgttttaatcttgttatattaatagtcaagctcaaaacaatatcacgagcgtatttctgactgattgaaaaccgccttctgttactatggcatttaccaaatcaaactgcctcaaaaactatgtggctcttgatgcttatcaggcaacatgtaattgcaatgattttcattgtattaactaaaatttacatatcttatagaaaaattaaattttcttactttaaccaaatccacctagcctagcctcctacctccacaaatatttactcaataattgtttgttaataactatttatatgctaaatgcacggaatatagcagtaaacacaagaatagtttcaggtttcatgaaacttacacaaaatctctcatgtatttccttttccctgatttgtaatatggggttattaagaccagcttaagttaacagcctaaggataaaaaatactacagtgtctcttcacctataatttacaatttaaaaaacactacacagaaatattcaagtaagaaagttttatttttcctgctatgactatgactgctttaaagtctttctgttctataaagttgcttcaaaaggaaaagtgtttggtgccctttattttactacactatttaacccactagatgctaactaacaaacatttaagttacatgaaactgaaaaatgtataagagcatcttttcatataaaattatcaaagtatgtcaatcgtctcaatttatatatagaagttattgccaaagtgtcttataatccaagacactgagagataggaagctaggataatgagtaaatccaaactgagagtaaatatgtgcataggttgtgcatagattaatcatagagttaaaacacatctgaaaacccatctctattaaaaaagaggagggaggtagccacagtggctcatgcctgtaatcccagcactttgggaggccaaagtgagaggatcacttcagctcaggagttggagaccagcctggacaacacagcaaaaccctgtctctgtaagaaaacaaaaccaaaaccaaaagaaacccaaacaaaagcacacatctgaatactgtaaaggcccagtcttccacagagtgagcatcgtttaaggtaggggctgtgtctcactcatttcatcagtatgtccactctacgattttccttaacatgtaacagtgatgaacaatttctcacgcacaaacatttcacatactgatgattttatcttgtcagtagaagtaccatggtttttttttccttgttattttgtttttgtcccaactagatagaaaattttataggttataaactaacatcggcaatttcatatggtccaacctaatatcaattgctcacaacattaagttcctagagctaccggtaggcaccatttcttattgctctaagtactcaccttctaataagggaaaagagaaataaaaagtaaactacaaagcagtgcaataagtgctctcctaaaagtttgttgtgtgtatctgtgacagagggagacagacagacatacagttccttaggaatcacaagatataccagttgatgaatcctatgaggaaaactggagggcaacctagtaaataaaattaactaagattcctttgctaagtgatcgctatactgagatttatatatttaaataaatataaaattaccaggaaaccactaatttcttcctaagatgagatacaagcaagaatgcctgctcttaatcactcttacttaatatcatattgaaagaaagagcactgccataagggtagaaggaataagggatatatagtttggaagggaagaaataaaagtgcttgcattcacagacaacatgattgtctttatagaagattccatggaatctattaaaaaatgcctagaattaataagtttagcaaagtcatagattaccattgctgtttctacatactaccaatgaacaactggaaatcaaaacaaaaagcagtaccatttataataataccccaaaactcaaaaatactaaggtataaattcaacaaaatatgtacagattatgtatgctgaaaatcacaaaatactgatgaaagacatcagagacaacgtaaagaaaacagatacaggagctcccccgttatccacagaggatatatgccacccctccctcactccacggaagcccaaacatctcaggtagtgctgaaccctatatatactatgttttgtccgacacaggttgaacattcttaatctggcaattcaaaatctgaaatgctgtaaactctgaaactttttgagtgctcatatgacgccacaagtggaaaattccacaaataagtacttaacagaaactttgtttcatgcacaaatttaaaatagtttacaaaattacctttgggttacacgtataagatgtatatgaaacaaatgaatttcgtgtttagacttgggtcccatctccaagatctctcattacatttatgcaaatattccaaaatcacaaacacatctagtcccaagcatttcagactaggaatactcaacctgtacatacataccctatgataaagtttaactgataaattaggtaaaataagagattagtaacaactaataataaaatagaacaattttaacaacacactgtaaaatgaaagtgagatgaatgtggtctctcacaagatactttaatatttttggaccataattgactgcaggtgtttcaagctatagaaaccaaaacagtggataatgggaaactactgtaccatgctcatggttgggaagactcaatattcttataatttcaatttttcctcatttaatttataggtgaaaagtaatcacagtcaaaatctcagtgggcttttttgtagaaatcaataaactgatgtgaaattcatatggaaaggaaaagaaattagaaaaaccaaagcaattttgaaaatcaataaaattgagggattcatactactagagtgctccagtaaggccaggcatattggctcacgcctataattccagtgctttgggaggacaaggtgggaggactgcttgagcccaagagttcaagaccagcctaggcaacatggcaagaccctgtctctacaaaaaaattaaaaattaagcaggcatgatggcgtccacctgtagtcccagctacttgggaggctgaggtgggaggattgcttgagcctgggaggtcaaagctgtagtgagctgagagcatgtcactgcactctaaactgggcaatagagcaagaccctttctcaaaaaaaagaaagaaagcaaagatagtgatattggagtaagaataaacatatagatccaatggaaggcgacagaagagtccataaatagagctacacatatatagtcaactgatttctgacaaaggtacaaaggcagttcaagacagtaaaatattatctttccaacaaatcaacctgaaacaactggataattcatttggaaaatgagggtaactgatacttgcttatatagtcataaaatctctaggtataaacaaaataatattggttggctacagtacaggaaaccagatgacttgggattgatgtgaatagagatggaagagacaatttttacattatactgtttgtattccttgtaaatcatgaactatgattgcctgttacaagttacacagatgaatcagatgcataccaatgtattaagaattacaaaaaacaatgctttcctcaataaattactaaaatgtgtgaaacagatacattttactctgccagtctgttttcttccagcacaaaggctgttaaaccaatcagaaatcattaggggtggagcctgggaatttataatttcaaacaagtgattctaattcagagctaaggtttagaaccaatcatagggcatggttatcatatgcaatgcactgtactgaccaagctgagttaataaaatatttccttccctcaaaggcaaaagcaaatgaccaagatataatgaatgtacatagaatattaatttggtcacatggtactacaaaggaaataatttaagaaaaataatttttgctaaaccccaatgaaaacattaggtaaagggttggtaggaaacatgatgaatcaagttgacaacatttgtacagactggtattatcactaggaatagagcaacttgttatgcacccacttgtgcaataatgtacgtatgtttatctacatgtctgtatgtgtgtatatatatgcatatatatcaacctataatacacatggcatacaggataaagtgataggtggctatatgcatattgacaattgctttattatacctgacagtctttcttaaaaacaaacaacagtggaatctaataaaatctttaaagctactgatttaccaaaaaaaagaggaatatgttaaacaacactgtgaagatacaatcagctaaagtagaatgtgggaaatcctacagaacaaatgacacaagttcttcaataaatacattcattttttaaaagggaaggggaacgtagtagagaaagagacttaggaaactaatcatatgcaatgtttaaatcctgtttagatctattctaacaaactaaccttcaagacatctgacacacacacaaaatgaaatgcaaattaattttgcttcaaaatactccaaagacattgaggaatggtaaaattggtaactggtcttaattcacaggggttcattaatgtcttttccgcatgacaaagtttaataattaaattattaacattaaagaaattcaattatatgatgatatcacaaaaaaagaaaataatgcaattttagattgacatctccctattaccctattcacagataatactgttttccttttttgacacttccttctgaaaaagttaaagtggttaggtccaaatttagtcactaaactttacagcaatacatatatgaaccaatttaaggaaatctagatctggtaaatccacatcagggtttctcaatgttggcactaccaacattttaggacatataattctttgtcatggggtccactcctatccattgccggatgtttagtagcatctctggtctctacccactagatgccagtagcataactcattcccctaaattgtgatgaccagaaatatttccagatattgccaaatgtcccctggagaacaataacacccctcatttgagaaagactgatttaaattaatgatttcttagaatggtgagcttactacaaaaagcaaaaggaactcagtagttacgttccttaaaatctggcaaaaacaacttcaataaaatgactagccagcaacagacaaatggtatttttctctatgttaacaggaatattcaagtatctgaagaaaggcttaaccttttagaaaatgtaaagatgtacaatccttacttttaaacacaatatattaaacaaattaggctttttcatggctcaagataatgaacattatatctacttatattcagctcactcaaaaaagtgggaataacatcacaatatatagcagaataagaactccaaatctccatcccttcacaaagcaatgaataggtggcaaaacagccagaatcaacattttcataattctagaattcaattaaaaccttataacaaccagaggaacatgtaatgaagaaagatgctgctaggttttcataggaaaacgctgtggaattttaatttactgcacaccactcccaactccccctacatggcagcatccatgatagcagcccacatctggtgcctgttgtgggtaccagataaactaatatggaccttattctcaaaaaactgtggttgtatgttttgaactatgtagtggctccctgaaggattgggtcaagggcttgtctttgttccaccatgcttggagattcctagtactgaagcatctttcccagtggtgtctgtcaaaagcatatctctctcatctgtgtgtaacaggtaacaactggggcaaacaataaacatctaaagacccaggaaggaagaagctggagaaggagatgcatatgaaaataaaggttttgaaagctcccatatataatagaaaacctagaggccacatgcgtgtccaggactggccatatgctcagagaagactcatgaagaccctaaactttcacctctggctgacctttcagctctgcgcaagtaaaaagtgaagactaggacagaactgtaagaagcttggctgagcattatgtaccccaacacagaagcaatttctaaaatctaggagagtttgtttttgtttgggcttttttggggagttgttggggggagatcgaggcatttaggaaaacctctgccaaattatagccgattgccaagagaatgaacagagaattcagtggacaaacacaatgaagaacacagactttacaaaaatagttttaaaagactcattaaacaaccaccagaacaagcagcaataacaatccccagggagggggaaacattggctctccagctacaatattcaaaatatccaatttccaacaaaaacatctgaggcatgcaaataaagatcaaactatatcctggtcacaagagaaaaagaaattaacagaaattgtcccagaggaaggccagacactgaatttactagacaaagactttaaatcaactgccttaaatatgctcacagaactaaaaaaaaaaccctggacaatgaactaaagggaaccagaatgtcatctcaccaattagagaatattgatgttaaaaaatagaagtcacagaaaggaactaaatagaaattctggagctaaagaataaaataattaaaatagaaaatagctagttctttgaaaacatcaacaaaactgataagcttttagctagactgacaaaaagaagacccacattactaaaataaaaaacaaaagtaggcacattactactgaccttatgaaagattactattttaattgtaagccaactagcctatttatacaaaatggacaaattcctagaaacatacaaactatcaaaactgacccaagaaatagaaaactgaacagtcctataacacagtggtcccccaccttgttttgcaccagggactggtgttgtgaaagacaatttttccatggagcggggggcgttgggctgaaatcgtttcacctcaaatcatcaggcattagattctcctaaggagtgcacaacctagatctcttgcatgcacagtttacaataggcttcctatgagaatctaatgctgccactgatctgacaggaggcagagctcaggcagtaatgctcccttgaaggccgctcacctcctgctgtgcagccagttcctaatgggccgtggaccatctgtggcctggcagtcgcggacccctgctataacaaataaagagattgaataaagaattaaaacctcccaacaaagaaatgcctaggactacatggctttgctgatgaagtctaccaaaaatttaaagaatcaacataaattcttctcaaaataaaagaagagggagaacttgaatattcttcaacaaatagcgctaggacaactggatatccacatttcttgaggccaaaactagacacttcataccaaaactagaaaaagacatcatgaggaaacaataaactaacatcccttatgattatgtaaaaattttcaataaaatactagcaaaccaaattcagcagcatattgaaagaattgtagaccatgtccaagtgggacttataccaggaatgtaagggtggttgtacactttaaaatatttaatatatcacattaataaaatgaaaggaataaaaacattataatctcaactgatgcaaagaaaaagcatttataaaatccactacgttttcatgataaaaaacactcaacatcatagaagggaacttctttaccatgataaagatcgtttatttaaaaacccacagctaatatcacagttaagggtgaaaaactcaatgctttctttcaaagatcaggagagagataaagatgccacttttcaccacttttattcaacactgttctacaagttttaactagatcaactaggtaagaaataaaagccattcaaattggaaagtcataaaacaaaccaaaaaatcatctctatttgcagatatgatgttatacatagaaaatcctaaagaatgttttgttttgttttctttgagattgggtctcattctgtcatgcaggcgccatctcagctcactgcaacctccgcctcctgggctcaagcgatcctcccacttcagcctcctgagtagctgggaccataggcatgtgccaccacagccggctagttttttgtatttttgatagtgacggcatttcaccacgttgcccaggctggtcttgaactcctgagcttaagtgatctgcctgcctcggcctcccatagtgctgggattataggtgtgagctactatgcttggccaagaattaaaaaaaacaaactatcagagctaatgaacaaattcagcaaagttgcagaatataagataaagtcacaaaatctgttgcttttctatataccagcaatgaacaatccaaaaataagaaattaagaaagcaattctatttagcatcagaaagaataaaacttaggaaaaaattagctctgatagtttgatgactaagaaggcccaggcctaaaaatggacacaaggaaaatatttacaaataataaaacacactattggtgtgctgagtgtgtgcatgtgcacatttgctatcaggtatcacttatgtcaaaacgacttacttttacagaacaaggagttggtttaaactcattggtaaaaggcattcctaatagagggcaggatgcaaagttgaccaggatgcaggaggacagactggtagaaatatacattgatacagcctctgtgcaactggcaatcactagcaaaattttcaatgcacatcccactgaaaaagatctccaagatatattgggggtgaggggtagtacaaaacaatcaaataagccaacttgtgtgttaaaagggggagaaaatcaagaatagatttgatatgcttggcttatctgttgtaaaatttgcgttaccagtactctccacatcacagggcagaaatcttaaactacatttcccagaatctctttttatggaatgatttaaggatagtgtctgccaatgaggctcacgcatgcaagattaaatgaagagaaagaaaagcaattcttgtctgatggcaactgggagtaaattcatgggcagacgataggcatgaggttggaagcagctgttgcattaagaaacatctgccttttctggattcaatactgtacaacgctaatttttcaaattaaatccataatctcaatggaatatcagtgatgctcaacagttttcatggcacttcaaaatgttttaaaaatttatatggaagaccaaagagtaaagagccaattcggggcggtgggggaggaaggctgaactgcacatcgtatacaagaataaaattctaggtcattcagaaaactaaatggaaaaaaaatttgcaaatttttagaagaaacagaatattttttaagaccttgtttcttacacaacacaaaaaagggggaaaaacccataaaagattgataagaatgatcatactataatttaaaagttctgaatgagtgacccctaaaacaaagtagactagccacagattgagaggtataacaaaaccaataaaagattcatagcctacctacagatagatagataatagagatatatacttaccactacaaagcaaagaaaaaataggcaattcacaaaaaacatctaacttgtcaaaaatatgtaaaaatatattttatctctttagaaatccaggaaacacaaattaaaacaaagtatcactcatatacatcagaatgccaaaatgaaagtcaaactaaaataattatcggcaagtttgagagtaaagaatgactcttactcaattgcttgtgacaatataatcagtacagcccctctgaagaaaataataattacataataaaggtgaacatgtctatatcctatgacccagcaattttacctccacatatctatctcagagaaactgtacaaaaaaagatacacattatactagaatttctacatcactatttgtaataactaaaactagaagatacctaactatagaaagttaagaaaatagataaacagcagtttatttgtatcagatatacagcaactattatttttatttgtatagatttatcaggcacaagtgcaattttgttacacgcacagattgtgtagtggtcaaatcagggcttttggggtatccccaaagatacagatatatagaaattacaacaaatgtattatcatggataaattttaaaagcagtgataaaaagatacataaagcataccattaatttaaaattttagaaaacataacagtaatattatactgtttatggatatgtaaacacagtataagtgaaaaaagcctagatgataaaagctaacttccaaggtggttacctaggaaaaaaggggagcagagctctagttatatatgtaaatatttcattctttaagagacacaaagcaaatatggcaaagtattcacagctgtttattcctagtgataggtagttaggtttatattttattttatcctgtgtgtctgaacatttctatttgattaaaaccatttttcaagaaagatcactgattggtctgagtgtagaagatgaactgaaatggcggcaaaattggagaagagtagactggccagagaactactgcattagtccaataagaaatgacagcagcaggaactaaagccatgaaagtgcaagggagagatcaatattacatatacatacaaattaggactacagagttcttcatacagttatgcaagtacggtatgcctgtaggtcattctcctttctttaaaatctcctatattagacatttctcaaatgaagacacaaatggccaagtatatattttttaaaaagttcactctctcatcaccagggaaaggcaaattaaaaccatgagatatcatctcacacctgttagaacagcttctaccaaaaagatgaaagaaaggtaagtgctggcaaagatgtggagaaaagagaacccctacccactgttggggaggaatgtaaattagtacagccattatggaaaacagtatgaaggttcctcaaaaaattaaaaataaaattgccatatgatccagtaatcccactacagggtatataaccaaaagaaatgaaagcagtatgtcaaagagatatgtgcactcacactttcattacagcattattcaaaatagccaaaacatagaatcaacctaagtgtccatcaataaatgaaaaaaaagtggtatatgtacaccctgggatactattcagccttaaaggaggaggaagtcctgtcactgcattaattttagcccttactttgatgcattttgagttaatttttgtgaggtaagggatcacatttattcttttgcatgtggggaaatctagtttccccaacatcatttgttgaaaagactgtcttttgcccccattgaatggccctgggaccctcaaagtaagagctaaaactgtaaaactcttagaagaaaacacaggggaaaagcttcatgacattggatttggcagtgattccttggctatggcaccagaaccacaggcaacaaaagaaaaaagttaaattggactttgtcaaagtttaaaacttttatgcagagaaggatactatcaacagagtgaaaaggcaatgcagagaacaggagaaaatattagcaaattacaaatctgacaagggattaatatccagaatatataaagaaatcctacaattaaacaacaaatttttaaatggacaagggacttgaatagacatttatcaaaaggtatacaaatggccaatcaacaacatgaaaagatgttcaacatcacaaatcattagggatatgcaaaccaaagtcatgaaataccacttcatacacgagaatagctattattaaaaattgttagtaggtactatggaagtgatcctgaaagttatttagagttaatgtataaaatatatggcagaatttaatatgattaaattttgacttcatatggctaaaaaagcatcacttacagatctgatgaatggagaattagatctgaaagaatgacaaagaattgcagggaatggtaaataagttattttctagaggtcaaaacaggcgaatgattatggaaaaattattaccttctgaaagtctcagagaaacatgaagttagggctggacgcggtggctcatgcctgtaatcacagcactttgggaggtgggcagaaacatgaagttaaacaccttacatgtaagagattgcatactcataaaaaggtgacatgataggagtactttagtagtcagtacactacagctttattctaaatatgttttctgtttctctaaaccatgaagataaactgtgggcttgaattttttatatgcagtactttgagaccctttgtattttcagtagagatggggtttcaccatgttggccaggctggtcttgaactcctgacctcaattctttctataacaccagcttaacaaaaatattagtatctgggggggtgggggggattattgccttcacatttttaacctaatctctgacagattttcccgatttcctctgtatcctccacaggtttgcaccacgctgcacttgttcactgacttcacagatatttcttgaaaccttaccaaagcacaaaccaaacttaccctttataaatgtgtaatcaagaccaagactctaaatcaaggtaactctgcttaattttatatagataagaaaacatctgcagaaagtacattcacgtctgaaatatatagccagaactttccaacaaagcccaaggaatttaaatctcctagcctgtagtaaccatacccagcaagagagacaaacttagatatctgcaggaccaatattagaaggctgtttttaaaatttttggtcttaagacctcttcacatttttaaattattgaagagcccaaaaagttttgcttatgaggattatttctactgatgtctactgtattcaaaatcaaaactaccgaattgcttaaaagtattatttttaatttatttactaatatatccactacataccaatataaataactttattaaaataattatttttttaaaaaattaagtagcactgttcatgtctggcttaacagaaaataggtggaatctcacagctgcttttgcattcaatttgctgcaataagttatcatggttcaagtatatgaagaaaatctatactcatggtagcatatttttagatacttgtggacaatctttgatattacatcaaagcttgacaagtgatatctcttagaagttaactataatgtgaattatgaagccatatgaatgagcttttagtacttttttcacattaaaatccattggtctaactgaactttgaatggatcttttttaacccatgtgtcattttacaatatcatatatcagtaatttggaaaatgctggttcactggtttacgaaggtcttcaattactgacacgtttcatgatatacaatatcaaaagtcatatttattaatattactaccaaagccaccacaaaacatctttaagctctgtaaaggtagcaagctcaaggtggccgatacagatttactcaaattctaattttgcttggaagctcaaatttcatcatctgtaacaaatattgacagtggctttccttgaagtgacaagttcactttgttccttttcaaggaatattttcaataaaaggtttgccaaagagccaaatctgaataaccataatgttagttgttttttcaagtaaaaaggtattctattaaaaaaaaaaaaaagtctagtccagctagcaactcaatcacataagcatttttcctgtgcagcatatactcattttatcatacagacaccccagggtgaagtgtaatgtaagtaatttatacttaaaaacaatcttaagggaaataggcttttccctccccttaactgtaagcaaggcagtgaaaaacacagtctggtgccactaacttgattcctaatacatcagcagtaagtactattacttttgtaccattaatgcgaatgtcgaagtaaaaaacgcatataacattttattattatgataacagttttgactttagggactcccaggggttcatggaccacactatgagaagtctcttagaccagggtccctaacccctggactgaggactgctagccattcatggcctgtcagaaactgggctggatagcaggaggtgagcagcgggcaagcaagcattaccacctcaactctgactcctgtcagagtagcgcagcattagattctcataggactgccaatcctattttgaattgcacatctgagggatctaggttatgtgctttttacaacactctaactaatgcctgatgatctgaggtggaacagtttcatctcaaaaccatcccaccccccaccgcacccccatccacggaaaaattgtcttccacgaaactggtccctggtgccaaaaacactggggactgctgcagtaatggattaattttggccaaagaaaggtttggcccttgctcagctcctaggaggtaactgctaaccccttggaatgtcctgcttgataaagagtcgttgtttacctgggggctttggtccatgacagatagtctaacaatatgattcttggtgggacctttaagtcacggagtatcagcttgacctctggaggggatggagactaacatcagccacaggtgtggtcaaccatacctatgtgactgacttctcaataaaaactctggacagcaaacctcacgtgggtggccttggttggcaatactccttgcgtgtcaccatatattgttgctgggaaaagtaagcactgtctgcacaaccccattaggagaggacatctggaagttcacgcctgaaactctcctggacctctgtcctatgcacctttacccactgttggttttaatccgtattcttttgatgtaataaaccataccattaatttaactgctttgctgagttctgtgagtctttctaagcaaattatcaaatctgagagtgcacaatctcccacaaactaaacaagctggtcaagatcaaactcctgagtatatataacaaaagccaatccccacctacatgtttctctacacaagacactgttttgcccaagaccaaaaactattgtgcatatgtgcacagatccaaattgcactgccaaactccacataactaccagccccttctccaagcagcttgttttagagcagggattctcaccaaatgattctttgttatagaggaacgtcctgtccacagtaggatgtttagcagcatccctggcctctgtccaataggtgccaatagtatccttccctccttcccagtggtaacaacaaaaaatgtctccagacactgtcaaattcccctgaggagaaaaatcgctctcccctcaatattgaaaatcactgtttcaggaaactcacctaggtagtctgaccttgccttatcttttacaaaaaaagggaataaattcacttttagctctaccttcctgcctttcctaatgttaattatttgatgatggaaagcaattgcacattctgagttctaccttcaaaaaatatctggatagaagtggtgaactaaaaactcttccttctggggaactcagtcagattaccaatttcaagagaaggagaagcctctaacaatgatctttaaataaggatacatatatattttctgtatcttatgcacaccacagagggaagatagactagttttcttcaaccttgggagtatacatcaaaataacccccagtagtttttaaaaatataggtgccagggtcctatctcagacacacttaatcagaattcattatttatccagcaattgagtgtccactatatgccaaagcattgttacaggtgctggagacacagcagtaaataaaagacatcgtatttgcccttgaagaactcacattccagtagagtgagacatttcataaacatatagacaaataagatcacttcagatagtgctacagggaaataaatagaataaaggaagaaatttctctgcattctcagcaatatctgcagaaatacattcaaagttaaatgtggtaagtgaaaatattattttgcattttattatttagaaagcctgtgacataattacatacctacatttaaaattccttatgtgtaggggtgctgagcaaaagtgtctctccctactctttgggaatctttaagctcaagattaggtaaattccctcccagtttcaattctaatttccatcagttcaatgaaaacattatgctaaattttaaaaataaatttaggggatacactgcagatttcttacatgcacttactgcattgtgatgaagtgcgcttttagtgtagagatcacctaaatagtgaacactgtatccaacaggtgatttttcaacccttgcccacctcccaccttttgtagtttctaatatctgttatccccttggtatgtcccatatacccttgtttagctcccatttagaagtgagaacatgcagtatttgactatgtttccaagttatttcacggaggataatgggctccaattccatccatgtttgctgcaaaagacatgatttcattctttatacatatacaccacattttctttatccaatcttctgttgatggatatttaggctgattccacgtatatgctacggtgaatagcgctgcaataaacataccagtgtagatacctttttgacatgatttctttcccttagggtatattcacagtagtgggactgcagaatcaaatggtatcactatttttagttctttgagaaatctccatactattttccataaggattttactaacttacattcccaccaatagtgtatagtgtataagcattcccttttcttcacacctgtgatggttaaaactgagtgtcaacttgattggattgaaggatgcaaagtattgatccagggtgtgtctgtgagggtgctgccaaaggagattaacatttaagtcagtgggctgggaaaggcggatctacccttaatctgagtaggcaccatctaatcagctgtcagcacagctggaatatgaagtaggcagaaaaacgtgaaaagactagactggtgtagcctcccatcctacatctttctcctgtgctggatacttcctgccctcaagcattggactccaagttattcagttttggggctcggactggctatccttgctcctcagctggcagatgccctactgtgggaccttgtgatcatgtgagttaatacttaaactccccttcatatatatataatatataaaaatatactacatattatgtactatatatatataaaatatatacattattttttatatatataatgtgtgtgtgtatatatatatctcctattagttctgtccctctagagaaccctaatacagcacccttggcaacatctgttgtttttttgaccttttaatagtaactaaccattctgactcatataagatggttttaacccatttatgctggaagctgcaattatgagtgaaaaatcagaacttggcaatgaccttgagcagtaggatataaataactcccacatgcttagtgttccaataatggaacactaggcataagtggattaatttgtatttcttttatgactaatgatgttgaggattttttcatgttttttggccacttgtatgtcttcttttggaaaatgtctgtttgtgttatttgcccattttttaatgtttgtttttttcttaagttccttgtagattctggatattagccttttgtcagatgcagttttcacattttgcacatattttttcccctttctgtaggttgtatgtttactctgttcactgtttcttttactgtgtgaaagcttttttaaaattgtctcatttgtgtatttttgtttttgaggacttggttataaattatttgcctagaccaatgtccagaatttttctcaggttttcttcagtatttttatagtttcaggtcttatgtttagctctttaatccatcttgagttaatctttgtatatggtgagaggcatgggtccagtttcattcttctacatatagctatccaattttcccagacccatttactgaatcgagtgtcctttccccagtgtatattcttgttgatgattagctggttgtaggtatgtggctttatttctgggttccctattttgttccagtaatatatatatctatttttatgccagtaccatgttgtgttggttactatagtcttgcagtatattttgaagtcagataatgtgatgcctccacgtgctcttgaacatgggagagtttaatgattttattaacaagaataaaaagagctcctgaagaagtcaatcaaaggggaaaaaatccactgaaaagctaatcatcataaggattgtttacaacagaatctggcaagactggagaaggggacatttttctcctttcatttcatacttctatgaaaaactggtagcaaaacccaggaatataaaaattttctgctcttcagttttttctaagaagcaaaaacaaagctatttatacatttatagaaaggatatttctatggttaaaaatactaaagttgtgggtaccaaatatattttttaaaagtaaagatcaaacacttccctgttatgtcacaagtaataaaaagaactgctgataatacccaaccttcctttaagaattaaaaacaggggtgggcaaatcacttgaggccagaagtccgagactagcctggccaacacggcaaaatgctctctctactaaaaatacaaaaattagccatgtgtgttggcgcacacctgtaattccagctactcgggaggctgaggcatgagaatctctttaacttgggagatggaggttgcagtgagctgagatcgcaccactgcactccagcctgggcaaaagagcaagactctgtatcaaaaaaaagaaaaaagaaaaagaaagagagaattaaaaacaaaggtcagatgccagaggatgttttatctaatttttcaatacacacctcattccatatacacaaacagtaagcaatctgttcatcctataatagtggctttgcaaatctcacagaatgctatcatggttcccattctacaaactatatcgcattctgccacaaataggcaaatattttatgcctacaagaaaacagctatttggatataaatagcttttaattgcctgaaacaatagagaaggaggaatcaacaacaacaacaaaaaaaggtagattcacgttcctcttacagcctgtggcttgttgctgccatctctaaacaaacatttagaactcatctttgaaaagtcctttcctcacatctgaggacagaactctgtataaaagtttccaatggttgcccccacagctataagaataaggttcaagtctcatagcttagtaagatacttagaaattgacgtctacataacttctctcccagcctcatcttgtgccatcccttcgcaatccttagtcaactaataccacacttaagatcatgaggaatatgatccccaattgagaagatgggagtaaactggctaactctaaaatgtattattcaggggatatagatgaaagacagatactaaaggaagttctccaggaccaaagtgacactagacagtaatgaatccacaggaagaaataaagagcactggtaatggtaattacaggtaaaggaaaaatgacagtataaaaggctgtataaatataacttctacttttttcttctcttaagaggtaactgcatagaacaactataaaactgtattgtcaagtttatcccatataaacatatgaaaatgaagcacaaaaatgggagtgaattatattgaaaaaaagagatgacactagatggtgactcaaatccacaataaaaaagaatactgaaagtggtaaatatatacattaatataaaagactataaatgtttttctctttcttctttaaaagataaactctatacaaagcaataattaaaacattactgttgggtttattacataaattaacataatatatatgacaacagtaaaagagacgagagaaaatagttataccggaggactattactatgtaacaatcattattaatctgaggtagactgtgatggaacaaacgctaaaaatataatttttaaaaatcaaataaaaaatagaaaatagaaaaggtgataaaagaggaacataaaagacatgagatgtatagaaaacaaatagcaactgagatacaaatccaaccatttcaaaagtaatattaaatataaaaggattaaacactccattaaaaagagagattgttggattggatttaaaaagcaatacctaattgtatgctgtctacctaacactttagattcaaagacacaagcaggctgaaacgatggaaaaacatataccacacaaagaatacccataagagagctgaaggagttatatttgtacctgacaaaacagactttaagtcaaaaaaagttactggagacaaagaggaacatttttttaacattaatagtattaattcaacaggaagataaacataaacatatggagctaacaggccaggcgtggtggctcacgcctgtaatcccagctcacacctgtaataacaggccgaggcgggcagatcacaaggtcaggagatcacaaggccaggagatcgacaccatcctggctaacacggtgaaacccaggctctactaaaaatacaaaaaattagccgggcatggtggcgggcgcctgtagtccttgctacttgggaggctgaggcaggagaatggcccgaacccaggaggcagagcttgcagtgagccgaggtcgcaccactgcactccagcctgggcaacagagcaagactccgtctcaaaaaaaaaaaaaaaaccataaaaaccatacggagctaacaaaacagtcccaaaatagggaaatcaaaaaaatgacagaaatgaaggggcaacaggcaatttaacaataatgattagagacttctatgttccaccctaacaataaataaacaagaaagcagggaattagcaatgaagatctgaacaacactataaatttgacctaactgacatctatagaagactctgcccaacagcagtataacttattctcaagcacatataaaacaatctccaaaatagatcacatgctagatcataaaacaagtctcaaatttaaaagaactgaactgatacaaaaaaatgtttttcaatcactgtataagtaaattagaaatcaaagataaaaagaaatttcagaaatccaaacatgtttgaaaattaaacaagacacctgtaaataaccaatggactagagagaaaaatcacaaaggaatttagaatacattctgagcagaatgaaaatgtaaacaaaacacatcaaaactcataggatacagacaatgcagtgtttagagggaaaattatagctgggcacagtgatgttaaaaaagaaaattctcaagtgagcttcaaccttaagaaattagaaaaagaggagcaaaccaaacccaacacaagtagcaggggaaaaaacaatcaatattagaggaagaatcaatgaaacagaaaaaagaaaaagaagaaaatgaaaaccaaaatttggttttttaaaaagaccaagaaaactgacaaacctttaattaagctaaccagaaaaaaaaaaaaaaaatgaagatactaattaccaaaatcaggaatgaaagagagggtatcgctaccgaactcagaggaattaaaagaattttaagggaatattatgaacaactgtatacaaacaaatgtaaacaacttagaaaaaaataaattctaagacacaaattactgactctgaagaagatacagaaaatatgaatagaactctatcaactaaagaaattagtaattaaaatcttcccacaaagaaaagccttggcccacatagtttctttcactggtgaattttaccaaacactaaagaaataatattaatccttcacaaactcatctagatacttcaatagaaaacactttctaattccctccatgaggctaacattaccttaataccaaagccagacaaagatatcacacgaatagagattttttttaatcctaacaaaatatcagcaaaccaaatccagcagcatacaataggaatcatacaaattggctattcttaaaacattaaacataagcttattatacgacccagcgattctactcaagaatctttgtggccaggcatggtgggctcacacctataatcccagcactttgggaggccgaggcgggcagatcacctgaggtcaggagtttgagaccagcctccagcctggccaacatggtgaaaccccatttctactaaaaatacaaaaaacttagtcgggcatggtggcacatgcctgtaatcccagctacttgggaggctgaggcaggagaactacttgaacccaggaggtagaggttgcagtgagccgggaccacgccactgcactccagcctgggcaacaagaacgaaactccgtctcaaaaaaaaaaaaaaatcttcgcaagagaagttaaaacgtgtccatacacagactcatacatgaatattcatagcagtattattcatagttgccaaaaatgggaaacaattcaaatttccatcaacttgtgaatggataaacaatatgtgatatatccatacaatggaatactattcagcaacgaagaaccaattaatacatgttacaacatgaatgaacctcaacaacatttataccaaatttttaaaagccagacaaaaaatgatcacgtatcatatgactccacttatataaaatgtccataaaagtttataaaataaaaccattattcaatggtggcctggggctggaggtgggactaggagtaactgcaaagtaggtacaaggtatctttttggggtgatgaaaatactctaaaactggtttgtaatgatgagtgcaaaattctttaaatttactgaaaacaaattgcactcaagacattttatgaattttatggtatataaattatacctcaataaactgttaaaaaaaaaacacactgatctaaccaatcaccagctcttttaatccaacttaaaaggctgatcagctgttcaggaccttagctgtagaagacataacaaaaaacaactgaattacagctggagagaaccaaagtgggtaaaagggaagattttctgacatgttgattcagcacacaggaacaccaaaccaatgaaaactataatcacatttcagaatcaatgtggctcagatagagggctacttgaagagtgggtcaaatttccatctgcagggtaaataataacatgatacatgaaccagacaaagacacattaaaaaaaaagaaaacgataggccaatatcactgagtaatattgactcaaaaaatcctcaacaaaatactagcaaaccaaattcaacaacacactaaaaaaaatcattcatcatgaccaagtgggacttatcccccgagggatgcaaggatggttcaacacatgcaatcaattaatatgatacatcatatcaacaaaatgaaggacaaaaaccacatagtcatgtcaactgatgctgaaaaagcatttgataaaattcaacatcccttcataataaaaactctcacaaaactagatacagaagaaacatacctcaacataatgaaagccatataccacagacacatagctagtatcacactgaatggggaaaattggaaagtctatcctctaagatctggaccacaactaggatgcccactgtcaccactgttattcaacatagtactggaagtcctagagaaatcagacaagagaaagaaataaagagcatccaaactggaaaggaagtccaattatccttgtctgcagatgatatgatcttatatttgaaaaatcctaaagactccacacacaaaaaaactattagaactgataaattcagtaaagttgcaagatacaaaaatcaacatacaatactcagtagcatttctatatgctaacagcaaacaatctgaaaaagaaatcaagaaagtaattccatttataacagctacaaataaaataccaggaattaaccaaagaaatgaaagacctctacaatgaaaattataaaacactgatgcaaaaaaattgatgaagacacacaaaaaatggaaagatactccatgttcatggattggaagaatcaatatcattaaaatgttcacactgccaacagcaatctatagatttaatgcaatgccaatgacaaaataccaatgacattcttcacagaaatagaaaaaaaaacaatcctaacatttatatggaacaacaaaagacccagaatagccaaatctagcctaagcaaaaagaacaaactggaggaatcacactacctgacttcaaattatgcaactgaactatcctaaccaaaacagcatggtattagcataaaaagacacatagatcagtggaacacaatagagaacccagggataaatccacacacctacaatgaactcatttttgacaaatgtgccaagaacacacattagggaaagggtagtctcttcaataaatggtgccaggaaaactggatctctacatggaaaagaatgaagactcctggccgggtgtggtggctcacgcctgtaatcccagcactttgggaggccgaggtgggcggatcacttgaggtcaggagtttgagacaagcctggccaaaatggcaaaacactgtctctactacaaatacaaaaattagccaggcatgatggtgcacgcctgtaatcccagctactcaggaggctgaggcagaactgcttgaacctgggaggcagaggttgcagtaagccgagatccgcgccactgcactccagcctaggcaacagagcaagactgtgtctcaaaaaaagaaaaaaagaatgaagacccctacctcttgccatatgcaaaaatcaaatcaagatggattaaagacttaaatccaagacctcaaactatgaaactactgaaagaaaacatctgggacactcttcaggacactgactgggcaaagatttcttggctaatactccacaagcacaggcaatcaaagcaaatatggacaaatggggtcacatcaagttaaaaagcttctgcacagcaaaggaaataatcaacaaagtgaagagacaacccacagaatgggagaaaatattttcacatcaagttaaaaagcttctgcacagcaaaggaaataatcaacaaagtgaagagacaacccatagaatgggagaaaatatctgcaaactaattctctgacaagggattcataaccagagaatataaggagctcaaacaaatgtacagaaaaaaaacctaataacccaataaaaaaaaatgggcaaaagatctgaataggcatttctcaaaagaaaacatgtaaatggcaaacaggtacatgaaaagggtctcggcatcactgagcatcagagaaatgcaaatcaaaactacaatcatctcaccgcagttaaaatggcttttatccaaaagtcagacaataacaagtgctggagaggatgtggagaaaagggaacccttgtacactgttggtaggaatgcaaactagtacaaccactagggagaacagtttggaggttcctcaaaaaactaaaaatggcactagcactaccatatgatccagtaatccatctgcttggtataacccaaagaaaggaaatcagtatattgaagagatatctgcactcccatgttattatataggcataatttatatgtataatgttatatattgtgtataatttttatatataacataatttatatataattttattttataatttttatattattttataataattgatatataatatgcacattatatataaaaaccttggttattattcacaacaaccaagatttggaagcaacttaaatgtccattaacaaagaatatatggtccatacacacatactgttcagctataaaaaagaatcacagcctgtcatttgcaacaacatggaactggaggtaattatgttcagtgaaataagccaggcacaaaaagacaaagtttgcatgttctcacttatttgtggaagctaaaaattaaaacaattgaactcatggagacagacagtagaaggatggttgggaagaccatcctctgagacccatcctttctcagaggctgggaagggtagttgggggatggaggggtggggagggttaatgggtagaaaaaaatagaaagaatgaatatgacctagcatttggcagcacatcagggtgactatagtcaaaaataatttaaatgaacattttaaaataacaaaagagcataactgggttgtctataacacaaagcacaaatgcttgaggtgatggataccccatttacccagatgtggttagtatatgcactgcatgcctgtatcaaaatagctcctgtaacccataaatatatacacctactgtgtacccacaaaagctaaaaacaaaaattttttaaaacataaataaaagtttggtttttttggaatattacatatattaatatttaaacttgacatatgctgatgggaatgaatgttttcactaaccaaagaaattcaactcaaacaactttgatttactgctttacactgaagaaaacaagatttttaaagttatactgttatatatagcacacccggacagaaacaagccttgttaaggctaaattatgtaatgagtgttgcttatctggtatattagactgttctcgccttgctataaagaaatatccaagactgggtaatttataagaaaagaggtttaactggctcatccttttgcaggctatacaggaatcatagtggtatctgcttccagggaggcctcaagaagctttcaatcatggtggaaggcaaagaggtagcaggcacatcacatggtgaaagtaggagcaagacagatcaagtggcgaggtgccacacacttttaaatgaccagatctcatgagaactcactatcacagggacatcatcaaggggatggtgctaagccattcatgagaaatctgcccccatgatccaatcacctctcaccagaccccaatcccaacactaaagattacatgtcaacatgagatgtgggcaagaacacacatccaaactctatcacctggttttgccccatctgagcatcagaatcttaatagcgtccatccggacaccaatatacaacaatatgtagtggcaggaggagaagtacaaaaaaaatgaaaaataagagataaacaatacacctcaatttcaaataaggatagaattaggagtacagcagaatagtttgagccaaaaataagggaaaaaaaagagagagaggcagaaattaaagtgtagaaataaaacaatttacaataaggaaaggtatcaataagaaagcaatgggtaaaaaaaatgaatacaaataagagataaacaatacatctaaatttcagataaagatagaattaagagtacagtaggccagtttgagccaaaaataataaaaaaaaaaaagaggcagaaatcaaaatgtagaaataaaacaatttacaataagcaagggtatcaatacgaaagcaatgggcaagttgcaagaggcagaagatggagatgaaaaggagaagactgaaagcgtgtgtacattaggagttaaggcttaaaaagttgggccaaaagggctaaaggaagggaggttaaggtggaaatgcaggaacgaaagctgggtagggtaggtgatagttgaagaaaaaggggatgggtgttgtagagaacaaaatgaagaataaagctccataatggttgatatgaagtgagctgggagaccctcaaatagcccagaataatgcaggcatgggataattatgcctacaacacccagtctggactgattctggactgtgagcaaagaagtatcaatcaatatctagtaattaaagtagactggtcacccaaacaaaatctcaagaaatataccggtagtaaaaactgtcccatacttcagaaaacactattatacataatgttgctcaaatcacaaggtcaagacttctcaagaggtcagtttgtggcgaaagggaaccaaacagattagatgaagtaggttccaatacagcagagttcagattcactgtaggtaaagaagtgggagaactgacaatgaaaaaagttgtggtcagagaaaaaaaaaacaaaacacctcaatttcaaaactaaggctccaaggaggtaacagaacaagaaggtgagcaggtaaagggttcatgtgattttgtaatggatctggaaggcttataaggcagaatattgttagtaaggagacaacaatatgaacaggttgattagtgacattaaaagcgatactttaatagttaaaacataggaggttctaaaaccaataatacaccaagacatgtaaaataatctccgtattgataatctgtaatagttaaacagtcactgcacttaaatttaagtgaagatgatatacagaaattcagttttataataaaagattaactgaatgggaatttgttttattaagggactctatttgtattagtcggttctcacactgctataaaatacctgaaactgggtaatttataaagaaaagaggtttaattggctcacagtttggcaggttgtataggaagcatagcggtttctgcttctggggaagcctcaggaaacttataatcatggcagaaggcaaaggagaagcaggcatatcttacatggctggagcaggagcaaaatggggacacgggggtgctaggcacttttaaacaaccagatctcacgagaatgtagaacagtaccaaaggggaaatcccccatgatccaatcacctcccacaaggtcccacctccaacactggggattataactagaaatgagatttaggcacacaaatccaaaccatatcactattttaaaaataacttacaatgcatttcttcaaaatagcaagtcacctattattaaatgagtggattaactgttacataacatatacacaatcttccagaacatttctaaagtatatatatatatatattccatattacatttatccctcttgactagcttctcaattgggaaatactccaactaggttccctctttgtcctgagaatgtctaaaaggttacagctccttggcattatctgttgaagtttcttgattccagacatctctatttcaatcattcaggcacttacagacatgctagtttctaactacctgcctatgccttggattaggctacttattagatctacttgactaataccacacttgctattctatctggtttcaactccactgctcactctgatgctgaagtctgcttatacatcctttaaaagccagctgttgttaaccttcacgtattagtccactctcacactgctataaataactacctgagactgggtaatttacaaagaaaagaggtttaattgactcacagttccacaggcttaataagaagtatgactcaagaaacttagaatcacggtggagggcaaaggggaagcaagcacgtcttaatatggtggagcaggaggtaggggtatgtgccacacactttaaaccattgcatctcgtgaaaactcgctcactatcaagagaacagcaagggggaaatctgccccaacaatccaatagcatctcaccagtcccctcctctgacacatggagattacaatttgagaagaaatttgggtggggacacagagccaaaccatatcattccacacctggccactcccaaatctcatgtccttttcacatttcaaaaccaaccatgcctttccaatagtctcccaaaatcttaactcgtcccagcgttaactcagaaatccaagcccaaagtctcatctgagacaaggcaagtctcttccatctacgagtctgtaaaataaaaaacaagttagttacttgaaagatacaatggaggtacaggcattgggtaaacgttcctgttccaatgggagacactggccaaaacaaagaggctactggccccatgcaagtctgaaacccagcaaggcagtcattaaatcttaaagctccaaaataatctcctttgactccatgtctcacatccagggcacactgatgcaagaggtgagctctcaaggccttgggcagctctgcccctgtggctctgcagggtaaagcccccgaggctgctttcacaaacacaatatatacagggtctggaagtcaacagctgaaagcttacctaccatataaacgagttaaaaaatacaaacagtataaaccaagggcaacagttcctaaattctgaccattttataacaatcgaaagagctccactgattaaagtaatagtggatgctgtaatggataaatcccaaattatcacataacagaataggttatttttatttcatgctcacataaagtcaaaaaatctatgttaatgatcagctgggtgtgcctgaggaggctggagacaacccaggctgaaagaagttcagttctctttgacccctcatttccaaagttgctctggcaaccaccacccagccagcaggtggaaaagaaagacaatctttcaagggaggtttctatttgccaggactaaagtaacactcaacacttctgctttatttcctatggccagatttcaatcatatggccatccccaaacacaaaaggtctagtaaatataagttatctggggcctgggagaaaagaaaacaagtttggtaaacagcaagctagtctttaccacaagaggttttaagacacagattctggggcattacccccagaagatcatcattcagcaggtctaataggatcccaaagaatatgtatttaagcttgccaagtgactctgatgtatgctccaaagttaggaaacagtggcttagaaagtaaagaacttggagcaaacaagaaacttttccatgaaaaatttaaaagaatgtactaaataaagaaaaactaaaaagtgatgaaaaaattaagacttcatgtctaagagaatatagggtgcaactgggattgcttgtgatagcaatctcttatggctttcttcctaactctagcagcttcttagattttctttcctccattcattccatattttccatgatactctgctgggccatgagctttttctcattccttgagtgacctcattcactttaattatcacctaaaagcccagcctcacatttaactgtctactgtaacaacacttctccatttagatgtcctacaaggacctcaatatatccaaaactgaattcacctcaccttcaaaccagctcttccagcatgctctaaatcttaggccctctagtcaaatccccaggagttactgaagagtcatccttctccttcagcccctactatccagttatcaagtcctatcaattttacatcctaagtatctctggaatccatcccttttgccagtatcttaggtaaaaaccacttttcaaatggataacacttactaccagttccacctgcctccagcttcaccttcaacacaaacctatattctatactatcttccagaattgattcaaaacaaaatcctgcaccgattccctgctttgcctcttccagtggctcatgattgctttcagaataaagttccaacttagaactcagcacacaggatcttcatgatttggcccttatctccaacagggtcatttcttctcacttcaagtcctctgtgttgcaaccatatttacttcttgacagttctccaaacacactcttgtgtcctttggagtctggtatagcacttgatgcacaataaaatcagagtcaaataaatttacaaacagtcatgctgaatttggggcaacacaaatgtagctaactggaattatcaaataggcagatgttagagagattcaaacttaggtgaaaactcaaaaccagaaccacaaatttgggaatcaccactaaagaaacagtatttggaagtcttaagaatgaagaaactctgacaataatgtgatcttggttaaaaccaggggatttttctttcctaaactttcattatacccaaatagctaccttgtgcaagacaggggctatttaatccatgtttaagaagctaacaatagctgaatgtagtggctcacacctgtaatcccagtgctttgggaagccaaggtaggaggatcacttgagcccaaaagctgaagaccagcctgggcaacagagggagacccatctctacaaaaaaattaaaaaattagccaggcatagtggtgcatgcctgtggtcccacctactcaggaggctgaggtgggagaatcgcttgagcccaggaggtctaggctgcaagtaagccatgatcacaccactgcactacagcctgggtgacaaagtgagaccttaacttaaaaaaaaaaaaatatagcagcagctaacaatcaataaattagaaataggaaggaacttcctcaacctaataaaaaccatctatgaaaaaccaacagctacatcatacttaatgatgaaagatcatgaacaagacaaggatgtctactctcaccacttctactgaacaccgtactggaggttctagtctgggcaagtaagcaagaaataaaaagcatccagactggaaagaaaaaagcaaaattatctctagtcacggaaaattatctctagccactaaaaaagtattagtgctaataagaaagttcaacaaagttgtaggattcaaaagcaatatataaaatcacttgtatttctatatattaccaataaacaatctaaaaataagaaaattccatacacaatagcattttaaaaccttagaaatttaagaaagtccaaaacttgtactcttgaaactacaagatacgatgagattaaagaaccttaataaatggaaagcatcccatgttcatggaaagactattatcattaagatggcagtatttcccaaattgatctattgattcaatacaatacctatcgaaattacaactgtctttctggaagaaattgacccatggatgctaaaatatgggaatgcaagtgacccataaaagccaaaatcttaaaaaacaaaaacaaaaattggaagacttgcacttcccaatttcaaacttactactgaaggagtgaaggatctgtcattccaagatataagtcagattggtatagtgattattttgagttgaaaacattagagaaattgtagttttctacaaagacagggtgagctaacctgtctcttcctacacgcagccaagacataaagattcctctaggaggggtaccctcaccataccagggagagaaaaataacccttacttccagagagttggaattggaagctacaatggacctgaataaatattcttaaggaagtaatccttatcttctacctgtttcacacccctccccaatatatctcctagttaactcccctagaaaattttctgccccagccagattttctttgttctatcatttttcctcaaatttatcattctttgtctaaaaagtataaaagcatcttgctttggtcacttcttcagaattcaatctcttgtgaagatcaccatgtatacggaaaacttattaaatttgtatatttttctcttgttaatctgcctggtgtcaatgtggtttctagactcagctgaagagccaagtaagaggttaaagcagggttggaagcgatctctgactctgtacactacaaacctacagttatcaagacagcatggtactggcatggggacagacatatagaccaatggaacagaactgagagcccagaaataaactcccacatttagagtcaactgatttatgatacagatgccaagacaattcaatgggggaaagattacctttttcaacaaatggcactgggacaactgggtatctacatgcaataaaaaaaaaaaaaaatatatatatatatatatatagagagagagagagagagagagagagagagagagagagaaagttgaaatcctacctcatagcatatacaaaacaactcaatatggatcacagccctaaatgtaagagctaaaaacttttccttatattagctccctagggctaacaaatgaccataacagataaccataaatttggtagcttaaaaaacagaaatgtattctctcacagttgtggagagtactagcctgaaatcaaggtgaccttctgaacactaaggggaagtccttccttgccttttccagcatctgggctcctggagttcactggcttggaactgtatgactccaacctttgcctccatctttacatggccttctcacctactgtctctgtcttctcttctgttgggttcaggaggcttctgggctgaacacacggagattcctggacagtggcatccccagagagggcatggaagcttctactctttctgccatacttcaccctatgtatttcttccatctctatccttttgtaacatcctttagaataaataagtaaaaataaggttttccctgagttctgtgaactgctccaccaaattaatcaaacccaaggagggggtcatgggaactccaatttatagccagtcatcagaagcccaagtaaaacaacttggggcttgcaactggcatctgaagtggaggcagtcttgtgggactgcacttgtggatctgacaatatctacaggtagacagtgtcagaactaaactgaatgagaggacatctagctggtgtacactggagaatttgctgaagaactggttgcttccttggtatgtgggggaaaactgaaatgtgacacatttgctcacaaaagcattctatgttgtcagattatagtaagagaaactgggtttgttttttcctatatccttatcacaaataaatacttctccaaaatagacacacaaatggccaatatgcacatgaaaagatgctcaacatcattaggcatcaaaactgcagtaagatactacttcatgactgggtgcagtggctcacacctgtaatcttagcactttggtaggctggggagggggagggctgcacatggcttgaactcgtaagttcaaggccagcctgggcaacacggcaaaaacccatctctgccaaaaataaaaaaaaattagctgtgaatagtggcatgtacctgtactcccagctacttggggggctgaggcaggaggataacttgagcccaggaggttgaagctgcagtgagccgtgatcatgccactgcactccaacctgagtgacaaagtgagactctgtgtcaaaataaataaataaataaataaataaataaataaataaataaataaaagagatacaacttcagacacactaggatggctataatttaagacagacaataacgagtagtattgaggatgtggagaaactggaatgctcatacgctgctgggaatgaaaaatggtgcagccactctagaaaacagaatagttcctcaaaaggctaaatacagagttaccatactacccaatgattccattcctatatcccagagaaatgaaaacttacgtctacataaaatcttgtacacaaatgtttgtatcagcataacaaccaaaaaatgtaaacacaaatgtccatgaactgatgaatggataaagaaaatatggtatatccatacaatggaatattattcaccaattaaaaataaatacaaatacttgctacaaagtggatgaaccctgaaaacacaccaagtgaaacaggaaaagtctacagagacagaatagtagtcgtcaagaagctggcaagaatggaggttcgggggttgatagtttaggggtaaaaggtttttgtcataaaatgttctaaaatggattttggtggtacttgcacagttttgtgaatatattaaaaaacacttaattgtacaatttaagtttgtgtgtgaattacatctcaataatgctggttaaaatataaaaaagatcaaactttttaatatagaaattgttcaagagaaaaggctgcctctctatactaatttatgcttccttattataaaacctgtatttctttagtatttttggtaacaggaaataaatgtaattctcatctataacaactcttattctaagtttctgaatttctctactcaattgcctttttaaagtattttaactgtcttgtgctagatgttttaatattatctttggacttaaatcctgaggaatagaaaatacatatctttaaatttataaatagataaatctagacgagtaaacccttaccaataagaatgtcaacttacgccgggcatggtggctcacgcctgtaatcccagcactttgggaggccgaggcgggcggatcacgaggtcaggagatcgagaccatcctggctaacacggtgaaaccccgtctctactaaaaatacaaaaaattagccaggcatggtggcgggtgcctgtaatcccagctatttgggaggctgagagagaagaatggtatgaacctgggaggtggagcttgcagtgagctgagattgtgccactgcactccagcctgggcgacagtgcgagactctgtctcaaaaaaaaaaaaaaaaaaaaaaaagaatgtcaacttaaattgactaggcaaaagtagccttctcacaaaagctaataggcataataattctatccagactctactatgtaagccaatcagcatacacatagaagaatcctggtaacttttttttaaatcagtatcgcttaaggagggtggatgaataatttaatagcataactaagaattggggatgagggatgggaatggaaattaaacctaaaatatttgaaaattaaaccacttcaactttacattgtatacaatatcccagtaacagtttaaaacattactgttttaagtaactaataatttcattaattttggctttaaatttaaggtattactttgttactgatttgatatgatgtgaaccgcccataggatacattattcaaaacaaaagacctaatcctgaactatttcctccaggtacagggtattttccatgggcatctcaccccagtccagaatgagtacattcactgaatataaattttacattagactagaaaattaaaaaggaaataagacaaaatgctgaaaaaatgtatccaaaatctaactatttgggttatctgctctttaactaccataatcaatgttttatggttttttttgtttttttgtttttgagatggagtctcattctgtcgcccaggctggagtgcagtagtacgattctggctcactgcaagctccgcctcctgggttcatgccattctcctgcctcagcctctcgagtagctgggactacaggcgcccgccaccacgcctggctaattttttgtatttttagtagagatggggtttcaccgtgttagccaggatggtctcgatctcctgacctcatgatccgcccgcctcggtctcccaaagtgctgggattacaggcatgagccaccgcgcccggccctaaaatcaatgtttaattgtattttcataatgttgaatttaccctactggaactatgtatccaaaaaattaccaattatcatacaaatccaagacactctcaattgtagatacaaacaggtcattaatatagctatgagaaatattttaagatatactcactctcattcaaacttttgcctagtacttaatgttctcgatctgtactaaaatattttacgtatgttctgatttacagcagtagctacctaactggtcctgggtgtccctgtttgtctgccttttgtaatctactcttccaaaacctgtaatggttatctaactttcagtgatcatggacccctctgaggatccatacctgcacattcttgccaaaaccttcgcaggccctattttaaggaggcccagctcaaacgtcccatcacttaccaatgaagtccaaacttctcagcctgggattcaaagtacttaatgtagtcactgttaactaatttatcttctcttttccaactacacactccaatcaagactatctcctgattatcccatccatccttcctggcttgccttcacagttccctcttgttgctttcattgacaactgcttgctttcaacatccacatatacttctggtgaacctaaaatacctcccctgccatgagggtttccctccacttacaatcagattatctgatcctttaaattctgaaacatgttatctgcacctcttacagagctcaccaggttctattttgtattgcaaaaggtatccaaaaagtgaggaaacacagaacttgtttttgaactgtatgttacattttcaattaatatgctccacatgttttccttcagcctctataagtctcttcatgtgatgtatctcacttaccctacatctatgtgttttttttttcccctcttctaagatctgtaagggtagagatggtagctacttcacccttgtgtcccctgtcatctccagcacaaaacaggaagacacgccaggcatggtggctcacgcctgtaatcccagcactttgggaggccaaggtgggtggatcacaaggtcacgagattgagactatcctggccaacatggtgaaaccccgtctctactaaaattacaaaaattagctgggtgtggtggtgggcgcctgtagtcccagctactagggaggctgaggcaggagaattgcttgaactagggaggcagaggttgcaatgcgccaagatcgtgccgctgcactccagcctggtgacagagcaagactccgtctcaaaaaacaaaaacaaaaacaaaaacaaaacaggaagacacctcctacatagagtacctgaatatctgggcatcagtgttcttcttcaagtatttcatgcattctgtatcccctattgtaagatttcccaagaaccgtcattttttgtgtgtgttttttcccctcaaacaatgttccactcttagtgtgtacttgatcaaataagaacttattaactatccaaaatagtggttaagttactcacatccatccaacacctttctcactgatatatgccaaccctgtttaaaaaaacaaaacaaaacaaaaaaaaacccaacaccttaaacatatcagtcctcaccattaacccataagggagcacacaaagatggctcctacacaaaaatgatccaaatgtaaaagctattaccctttagtactgctgcaaacaaagttcataaaacaaattccaaaaacagaaataaatactatcccagattacacatatgcataccacggaaggcagtgagatgacctgagtacaggaacttcttttaggaattcctaaacatgatacaaaaatttatgaccaacagattcgtgcacaacatggaagaaccttaaaaatatgctaagtgaatgagacacaaaaggccatatattgtatgattccatttatctgagatatccagaataggcaaattcagagacagaaagtagattagtggctgccagggctgggagaaggaggaaatgaaaggtacagctaatgggtatggggtttctttttggaaatgataaaaatatttcggaagtggatggtgataatggtttgcccagtttggtgaacatactaaaaaccactcaactgtaccctttaagagggtgaactttatggtatgtgggctttatcgcaatttttaaaaagtgttttgaccacactggctgttttatctagaagaaaactgtatttaacgggaatcttattttgtagttttgttttttcatactgatctaaaccagcagttataaactggttccttactagtccctttttaaaaccaaagcattaattgttgtcaacggtagctaccgacttgccaacgtttacaaatacctgtagagagaggttttgtctagcaatctggatttctggcttccaaaaaaaaaatggagttctaaaaatgctaggcacaccagcactgcaacaatggcttgaagctaggcagccactaacatacttgttgttcttatttgccatgatgtccactactccctgttgtcttctaaacactgaagcccaatgtcaattaccatttagcttactggttgtgagtctgtgatccctaaacaatgatcttctacccttcttactagggtgtactgctgataaattaaaatgtaattgtggatgattacattttaacataccaactgcaagaataaaaactgtaacactgatatctgttagaaaaaaccctgcaattgtcacaaatttattcaaactaaagtgaaaattcaaggaaaaaatgtgtccattcctataaacagaaaaaaaattattttcagtttacaattaaaaatcattttcatctactcacagtcagaaagcaatgcagtaataacttcttacccccataattaggtggtggcacaaaatgagagaaaattatcttattcaaattgactggctatgagaacaaattgctttacttactgattttatgtttaaaccatctagaaccctcctgatgcttaaatgcacaaagaaaaacaacccttttgcatttgtagcttatatgtattaaactgtagtttacaaagccaaaagaaaacaaaatacaaggtgaacagcgaaacagacctaaaaaagtacattctactacttcctatgtcaagtgtatataaggcttttgagctaaaagctatggcaagtaccatccagctttagaagtctgtatgtccttacccgtatcttcttcattactccaaacaaaataatctagctgacctgcttttcctgtagacgggaaagtttaagagtatttgctttctatttcatttttaccatcaattccaatggctaataaaacaacatataagatgccctctaaaaacagctattccctttaaactaggcaaaaccaaacttatttctcaaagtcttccaagagagaccagatgagccaattactcagtagtttagaggaaaacctcaatgttcgttctccctgagccattaggtttacaagtgacatttatttatttatttttgggatggagtctcgctctgtcgcccaggctggagtgcagtggtgcaacctccgctcactgcaacctctgtctcccgggttcaatcgattctcctgtcgcagcctccagagtagctgggattacaggtgcgtgccaccacaccagactaatttttgtatttttaagagaaacggggtttcaccatgttggccaggctggtcttgaactcctaacctcaagtgatccgcctgcctcggcctctcaaagtgttgggattacaggcgtgagccaccgcgcctggccgcaagtggcattttaaagttcaatattaccactgaagattaatggatatacataagactggagtggcatcacaattttctcacaactgcaattccaaaataaaatccagttgcacttttgcttaacacaatcctgaaaaacacaatcctgtttctgttaaaacctaatggtgaatcaaatatgagtctctcctaaaagttcaccaaatttctaatgcacatagtaatctaaatcacaaaaacaactttgtcaaaaatgcaggactagaaacaaaggaaaacatcgatcagtcattacttcaaccattaacaatggaagcacaaagtgccatttgactggtaaaggttactggaaaacccagatctcgagtttcacactgttaagagtataagatgcacggactgtactggaattagcagaaatggttcctgctataactgtgctttacctgctattctctaacactgctgtccagtagaactatctgaaatgagataaatgttctatgtctgtcctatccaatacaatagccaatagctacatatgtctactgagcacttaaaatgtggctagcaaaactatggaacttggtttaatttcaattaaattgctacatgtggctagtggctctcttataggacagaacagttgtataatttgaaatacaaggtataaactgtattgactaaaccgtagtttttcaaagtatcatgacctgatgttaacaccaggcaagaccattctgatacctaatgatacacaaggtctgcgatcagcctaaacataaaattcacttatgaaatgagaattcttgatattagattcagaatttaaggtgcaatctttattaagtaatataaaaaatagtctcaggttcttccccattgttttcgcaaacggggtgctcactttcaaaatagttttccaaaacatccaagttattttcccttcaaatctgttcaacatcttctgttcaggaaaacaatggcaaaaataagttgtcaacactagtaagtgtcctgcgacaaattaatgtgtaaatgtcacacattaattttccttttccttaaaagagggggaaaatgtttggcagcgtccggatccttcaaaagccttattacccatctttccaaatgtttaggtgtacaaaacattcagatacagttgcgatttcgttcctagatacaaagtagtttttcagttccagagaattacaagtcattttgacttgtattctttgaccagctcttcataagtcaagaaaagtaacaagatggtgcacaaaatgtcaaaagaaaacaagtctggaaacttgcattgagtaactagtcgctaagaggaatcaattgcctttaacccggagagagagtccctcgcactacccagccaagcaaacagaacaaggtcgtgaccctgggtcacggccgccagtaccgctcccgcccggcagcggggaagccacctgttaggcccgagcctcacctggcaggaaagaggaagcgattgcccggcagctcgcccgacgcgagggcggtgagcgtggaacccgcccctcttgctgcagcggctagacccccgtcggcacgtgggcttcacccaggccccggcagctctgacaggcgggtcgcccgcggaccccggcccgccgtctcgcgcaggtccccggggcaggacccccgtttccctcgcaaccaccccgccgagcgggcgtcccagcggcccacaccgccggtccgccctgcttcccttccttcccggacggcgcgatcccgccctgcagcccctcacctacctggtcacggagtttgaggaacgccatggcggtcgcctccgcgcccactccagcctcctcctcctccgccgctgccgctgccgccgccgaccggcccactgctcccgccccagtagccttggccgctgcccgggaccagcgggtccgcggccgactgcgctgagaagacctgcgggcagggggcggcgccgcctccccggccgcccgccgccgccgccgccgccgccgccgccgagaggtgaggtgcccggccggtcccgcctcctcctctgaggactccccgccctcttccttcctttctttctccttccctctgctgcctgccctacccgccgctgccgccgccgcctcctcacgcccccttcccgaaataccctggcagcccccgcggccgcgccgttccagcccgcggcagcggcggcatccaaactccacaatattaccaccaccgcccgccgcgattggcggccgcgcgggggagaggccagagtaagccgagcgcccattggccacgccgccgcgctcgctggtgacccccccgcctaccgcgacgggaggggcatgcggaggaagccgcaagggtgggcgcggggccgcggctcgggcggggcgggggagtcggcaggggtgcgggccgggggagggcggccaggtgtcccggctcccaggcgctgccgcctcaggcgtggtaggcggagtccggggcggaggtggcgtggggaggtggggaacggcccgggactcgcacgtggaggtggagcgcggacgcctccctcagccagggcaagactaaggagctgggtgagggaccggaagggctggaaggggtgggcacctgggggctgcggcgagtggcgatgggcgagccggacttgcacgtggagaaagcgtgagaatgtgcccctgggtttggggagggtggggagccaaggagtgggatgagaggtggtcacggaatggggggcgctgctgtcctccccgggggctgcaggccgagaccgggtgaggggcgggggtgatgctggcactctggacggaagggcgtcgtcttcgcagccgaacaggttgtggacgcccaatcgtttttctgcccgtagtcccaatccgaagctaagctgtgtggttttcccttgaaagctccccagccaggcttgctgcctccacccctttcgcatctgaagcattttgcctcccactcgagagaaatcaattttcttaaacaaacaaaaaaaaagatgtgcaggatttctaataaatagcatccttggatggaggagaagaggaatgactccctcatcctgccacacacacccccacgccaccccgcagctctgaaacggcttttctttcttagccagccgcacgctgttgccattccaggctcgtgtgggagaagattgttgtgcgcctgggtctgtccgcccgggcggctccagcctctggtttataaaaggtgcagatggttaaaacacaaacgtgtgacgtcagggtcggtttttaaaagtctcttctacccactacatcagttgtgtctcttgggatggactttagagaatcgattcgagcctaatggcagtctagagaaatggagatcttcgtcaggactatcagattattgtaatgctgcacttataacaaaaaacttagatttagccacgcaaaaaaaaaaaaaaaaaagaaaatagagtgcaagataaaaaaacacacctgattaactgatagtacgacccttccaatattctttgagatatccatgctatggttccattgaaacaatttcttacctaaaattatgtccctcgtcatgatattttctacttaaaatggaggaattctcataactgtgatctaaccgtcataatgaggctaaaaaggaaatcaaactgctcttgctttgcattctcttcagtagctcctttaccctttatttcaactccagcagataaaatagagatactatttgtcacccaacccctccttatcagttcagtgagggtgaatgagttaatgtcgtgaaagcacttgagttctccaaaacaaagatgttgtgataatattactacagtactttgtgattacaagttagctttgtaaataattaccaatgtgccatatccagtcgtgttctatcttggcctaggagtgttaggatttaccctcatttataagtaagcctgttaagcactatggatgttgagccaggaattaatatagccctcctcttcccaccaaataatctctcctctaggttaaatttctagaatttaaaaacacaatgagaacctgattaggaacatggcaaagatgattttttgggagaatgtaagtgtgtttgagagtatgaatttatggactaaatatgcattttaatagattttgtgattgaagctaatgaaactttccaggactcttttgaaattttctaattaacagtaattaatgaaaatgttttatgatgtaccatctgcattatagtaggcatggagctctccttatagatgatgcttcacacctagctgggttctcacccttctgcaccatgagcaccatttaacttctctgtgtctcagtttcaacattcataaaaaaactaagcttaacatttcctggcctactcatctcacaccatcagataagatagtgatatgaaaggctgtggaaaactctgaaggaccattacactatattattattatgacagcaattacagggtacttcaaatgtttgtgggaaatagaattaaaggttaaaattgaaatataaactttatttctcaacatacgatttgtcaagttcaagatgataagcaatgataccagccatttagttcatccttaaagaaccgagggtcctgggaattcatgtcaatgcagtcttttttacagtaataatgtaatgttaataacagaagaaaaatgcatgccttttaaagaattgttaagattaggaaacaaaaataagtcagaaggagccaaattaggagtatgaggtggatgcctaacgggtttccatcaaaatcctaacaaaattgcctttgtttgatgagaggaatgagcaggagcattatgttggagaaggactctctagtgaagctttattgaacattttcctgctaaagcttttactaactttctcaaaaatactttcataataagcagatgttatcattcattgtccctccagaaagtcaagcaaaatctcttgaacatcccaaaagactgttgccaagacctttgttcttgactgatttgcttttgctttggctggacccttccacctgttggtagccattgctttgattgtgctttgtcttcaggatcataatagtaaggccatgtttcatctgttagaattctttgaagaagtgtacgagtgttttagggtcttgaccctacttgtttaaaatttctattgacagcctttctcttgcctgaaactgatctgggcccaatggtttgggcacccattgagttgaaagtttgctcaactttaatttttcagtcagaattatgtaagcttaaccaattgagatgtctgtggtgttggctcttgtttgtgcggttaatcgtcagtcttcttcaattaggatacaaacaagatattttcctcacaaattgatgtggatggtctgccactgtgggctttatgtttgacatcgtcttgtcccttcttcaaatgagttatccatttgtaaactgcttattttggggggcagggggcattgtccccataaactattcataaagcatcaatgatttcaccattcttccacccaagcttcaccataaacttgaggtttgttcttgcctcaattttaacagaattcatgttgttctgatacgggctcttttcaaactgacgtcttatccttcttagtgctgcaaactgtatcctgttcagatacattataacaagttaatataagtttatgttggtgaaaaaaaattgaaatccagcgagacacagtggctcatggctgtaatcccagcactttgggaggccaagacaggtggatcacttgagcccaggaatttgagaccagcctggccaatgtggccaaagcctgtttctactaaaaatacaaaaattagccagatgtggtggtgcgtgcctgtaataccaataatttgggtggctgaggcacaagaatcacttcagcctgggaggcagaagttgcagtgagccaagatggcactccagcctggacaatggagcaagactctgtctcaaaaagaaaaaaaaaggaaaaattaaaatccatgcatattttttcataatatgcattttccatgaactttttgaagatgccttgtacattttcatagctgctgaaaaaaataggaaaaaaaagtctatacggccaggtgcagtagctcatgtctgtgattccagcactttgggaggccaaggtgggcagataacttgaggccaggagtttgagaccagcctggccaacatggcgaaaccctgtctctactaaaaatacaaaaatgagctgggtgtggtggcgcatgcctgtaatcccagctactcaggaggctgaggcacgagaattgcttgaacctgggaggcagaggctgtagtgagctgagatcgtgccactgcactctagcctgtgtgacacagtgagactctgtctcaaaaaaaaaaaaaaaaaaaaaaaactatgcaattgagcaaaaataaggtgcatattcacattctaatatttttaaaatcttcattataaggctattcctgcttataatgaaatatttacatattagggaaattcttaacaccaaaaaaaaccgtatcatcgaagccaatggggccaggaacttaattgttgccagtaatcaatttttctctcttgttttccacgtctctttctttttctctattactacagccagtagctccactgacacattttaagtactctgcagtgataaaaagaaaagagtcaatattcctgagacatctgaagtaatgactaattggctggactagactcatgtgctcatgcctcagccaatcactactgcaaggtcttggggctgatgacaatctccattcagaattcatgtccaaaatgatagaaggaaagatgttatacagatgtgaccgccagggtatttgctgtgagctaggcagccacaccacgttttatttactgttctactactatttttactgttgggcacttgcacagcaccttatatgcttgcttcatttaaattttttattaacctttttatgttgggaactggagcccaaagaagttgtgtgttcccaaagttacccaactaatcaatggcagagcctggatgcataaggaccttgaaagccagaagagcagcttatgtggtaggaaatagataaatatttaaggctttttagccagataatccctatcttatgaaaatgcatataacagactaacaaagcagcaaaagggcgaagcacagtggctcacacctgtaatcccagcactttgggaggccaaggaaggaggactgcttaaagtgaggagttcaagaccagcctgagcagcgtagcaagacctcatctctactaagaataaaagttacctgggcatggtggcatatatccataatcctagctgcttgggaggctgaagtgggaggatcccttgagcccagaacttcaaggctgagcagtgagctctgattatgccagtgcattccagccaggatgacagagcaagactgcatctcaaaaaaaaagaaagaaagaaaaagaaaaggcagcaaaggtaagttcagagacccagaggctggaagtagaaggtccaacatatatttaaaagagtttcaggaggagagaaggaaggagaggtgatctccagagatgatgtctgagaaattttcagacttgaaaaatgtgagttgtcagatcaaaggagtacattgtctcaagcagaataaattttagaaattgagacctgtacatagtaatgaaattaaagaataccaaacataacaaaattatgttaaaagttaccactgagaaaagtcaaattaccctaagagaaatgactatcatcctgtcagcagatttatcaccaacagttgtgacagaagatgatggaaaatattttcaaagtattaagagaccaaaactgagaaactagaattctatacctagctaaaccatctttcaagagaaaggacaaaataaacacattttcaaaatttaggatgcacacatactcattcaaagaagtcctaggaaatatactgcaacaagaaaaaagctgaaacctgaagaaaaaaataaacaaattagcaagtatcttggttaatatgaatcagtagtatgtttttaagtgctagtattttagaattttaaaaccaggtgaaattaaaatatctattaaaatatggtagatgatggtaggagggagttctgagctaaaatattctggagttattttattcaaaggcaatgaaatattccttcaccttagactttgacaagttatactggttaaagttctttgttgtaaacaacagaatccatgcaggaattttaaaaatttataacaaaattattgagagagctggaaaaacaatcctgggctaaacttctagaaaaatgcccaaaaccatggcagaactaactggcatgctgttcccatcaagctccaaatatcaggagctcgacttttcttcatttgctcctgctcccaggatcagtgtcaattctgtgtctggaacttgatcttgtagccagaagagtagtagctgtctgcagagcttgtatcctcacattccttacatttccatgggtacatctagtaagtagagccaatgtcacaggcctgcattctaaccgcaagagaggcaggaaatttgagttcgcaattctatcctgggtaggtaggacctataatcagaaaagtatcccaaatatagaaaggttatttaaaagattatggcaaccatgactataacacaatccattactgatacacatgttaaacatttaaaggtattcaccaaaataaactagtatgtggaacttccaaacctatagagaaaaaaaaaatggcctagagaaaacttagttaatgaaatagtaggcaaaagagataaagagaggcaaattaacggtatgataaatgggaaactcaaatgagattgtacaaagaagtccaaggatattgttaatcacaataaatataaatggatttgatctgtctataaaaaaacaacaaacacattcagactgagtttttttaaaaaccagctatttgcaagatatatggttaaaacatattgcaaaagtttagggaaaggatttaaaaagaactgtataccaagaaaatattaatcaaaatattattcatctaataacatatcaggcataagaatttaaggaaagaaggattgataggaattaacaagtaatgtgtagtcatcataaaaggaactgtccaccaaaaagataaacagccaccatgtagtcatgaacttgtgtgcatttaaccacattaagcaaaatttgctgaaactacatagagtaattggcaaatgccccattaaaaacagaccaggcgcggtggcttatgcctgtaatcctagcactttgggaagccaaggctagcagatcacttgaggtcaggagttcaagaccagcctgactgacatggcaaaaccccatctctactaaaagtataaaaattagctgggtgtagtggcacatgcctgtaatcccagctggaggctgaggaagaaggatcacttgaacccaggaggtggaggttgcagtgagccgcgagagaaacagacaaaagggttgaatgccataaaatcaataagcttgatattatgtgagaatatatgcacacacacatatataatcaatagttcacaccactcccccaagacacgaagtccagccattttagaggtgaattttaccaaacatgacctttcttcgttttgtttcataaatagaggctaacatcaagtgtattaacaccgagattcctgatgcagcaaatgcttctcagataccttttatttcagcccaaccctctgacatccaagtacagttattttaaaaatagggccattcagaaccatttcatttattcaaaagctttttcaagaggatctctgcttaactactacaagtatctctctgctgctgacatcctttctgtggttgaagtagatgaaaaatataaataatagactacataagaaaaatatgcaacagttgtatacatagtataatataaactctgtaaaaaataaacagaaataagcaaacatctatgaatagaaaaaaactaaagaccagaagacagtataccatagtattaaatgaaattatgtttgaatgacagaagtatgagtcatttcttcatttatctgtattttgcatgttttctttagtgagaaatcattagtctccaaatatgttggcgttttatataaacttaaattttaataattatattgccacattggaataaaaaaagacatgacacaatgaaaataactcagaatggtaaaagaaattctttatcaataagtacattggttatgaatgaactagacatctccactaaaaggcagatattatcagactgaataaaacaagatatacacctgagattcaaggacataagtaggttgaaagtgaaagatggaaaagatacattatgcaaacagtaaccataagagatctggagtggctacattaatatcaaaatagtaaactaaacttaagaaatattactggagacattttgataaggggtcaatacatctagaataataaatattatataagaactgacctccaaaataaatggatgaagcaaattcaacagtagtagagatttcattttaaaaatctcatttataatatcattaaaaagtacttaggaataaatttaaccaaagaggtgaaagacttatacaccgaaaactataaaacagcatgaaagaaactgaagaagacacaaataaaaggaaagatatcttatgcatgtgaatcagaagaatgaatattgttaaaatgttcatactattcaaagcaatatacatatttaatgcaatctctatcaaaatcctgatggcattcttcatagaaatagaaaacaatcctaaaatttgttttatagaaatatatataaaacaaatatatttctttatagaaatagaaaacaatcctaaaatagaaaaaaatcctaaaagaaaaagagaaaaagctggaggcatcacacttcctgatttaaaattatattacaaagctatagtaatgaaaatagtatagtactggcataaagatagatacatagaccagtggaacagaatagtccagaaacaaatccaaacatacatgattaactaattttcaacaagggcaccaagaggacataatggggaagggatgatctcttcaataaatggtgctggggaaactggattttcacatgtgaaaaaatgaaattggacccttataccatgcacaaaaatcagcttaaaatgggtaaatgatctgaacataagacctgaaaccataaaaatcctagaagaaaacataaggaaaaagcttcttgacatggccttggcaataattttttggacatcacaccaaaagcttggggtacaaaagcaaaaataaatacatggaactatatcaaactaaaatgcttctgtacagcaaaggaaaccactaacaaaatgaaaaggcaacctacagatggaaaaaaaatttacaaaccatagctctgccgaggggctaatatctaaactttataaagaacttacacaattcaatagcaagaaaacatataagctgatataaaaatgggcaaaggacctgtttctccaaagatgacaaacatggctaacaggtatatgaaaagatgttcaataccactaatcagggaaatcaaatcaaagctactacgagttaccacctcacgtcaattagaacagctgttatcaaaaagacaagagataagtattggcaagagtgtggagaaaagggaacccttgtacacttttggtgggaatgtagattggtgcagccattatggaaaacagtatagaagttcataaacagaaatagaagtaccatatgacccagaaatcccctttctgggtgtatactcaaatgaaatcccacaaagatatctgcattcccatgttctttgtggcattattcacaacagccaagatttggaaacagcctaagtgtctgtcaatggatgaatgaataaagaaaatgtgttacatatacttacacagtggaatattattcagccttaaaaaaggaggaatcctggccgggcgcggtggctcatgcctgtaatctcagcactttgggcggctgagctgggcagatcacaaggtcaggagttcaagaccagcccagccaacatagtgaaactcctgtctctactaaaaatacaaaaaaaaaattagccgggcgtggtgcagggcatctgtagacccaactacttgggaggccgaggcaggagaatcgcttgaacctgagaggcagaggttgtagtgagtgaaggtcgtgccactgtactccagcctgggtgacacagcgagactgtcttaaaaaaataaataaataaaataaaataaaggagggatcctgctgtttgccacagtatggatgaacctggaagataggaagatattatgctaagagaaataaaccagacacagaaagaaaaatattgtatgatctcattaatatacagaatctttaaaaaaattcaagtatacagagatacagactaaacagtggttattaggaggaaggtgggaagtagagaaaatggaagatgtagttcaaatgctacaatgtaggatgaataagtctagagatctaatgtacaaaatgaggactatagttgataattgtgtattgctttggagatgtttgctaaatgagtagactgtagctgctcttgccacacaaaatgtgagtgccacacacgatgtgagatgatggatatgttaatttacttcactataggaaccattttactatctatatgtatttcacaaaatcatatgctttaaatatacacaataagaattatttttaaaagatttcggtaccccactttcaataattgataaaacgaagactttagcaacactatcattaactgatatttataaaacactccactgaatgacttcagagtactcattcttttcaagtgcacatgtaacattctccaggatagactatgtgatagagcccaaaacaagtctcagtaaaatttttaaaaagattgtgattgtacaaagcatgtgctctgaccacaatggaatttagagatctataagggaaagaaacctgagaaaacatcaaatatttggaaattaaacaacacacttctaaataacccatgagttgaagaaatcacaagggaaattaagttttactgaatgaaaacaaaaacacaacatcaaaatctatgggatatatctaaaatagtacttagaaataaatataactttgattcctatatcagaaaataataaaagacaaataaaaaatgtaagcttccaccttaaggaactagaaaacaaagagcaagctaagcccaagacaagcagaaggaataaaataataaatattagagtagaaaagcaatagataaaaaatttaaatccctaaaagttttttatttcaaaagatcaacaaaattgacaaacccttaactagactgaccaaggaaacaagagaaacattactaattaccaaaatcaagaatgaaggaggaataaagcaccaaaaaaactccacgtgatcttctcaatagagtaggaagagccagcaaagaagactgggataagagaaaccagaaaccaagagagaatgtatttcaatagagacagagtggtcaactggttgagtgctgctaattcctataaaagaaaatgagaattgaccattggattaggccatgtggtttgttgacaaccttaggaaggattttgggaaaatagcataaataaaaatctaattggaatgacttggaacagaactcattataagaagtgaagaagtggaaaaaatgaatacagacaactcttccaaggggttttgttaaaattaaggacagcagtgatttggagtagtagggagagagatgaaaagcctaagggaagttgtttttgtcttttaagatgggagatattatatgtatagactgaggagtaattgaaaggtaaaagggggaaaagttggtgatgcaagagagagtagatacctgcaggcacaaagtccttgagaaggcaggagggaatgagatgtagttcagaagcaaagtatgtcaggaactctgaagggtctgagattttactgtatttgtaagctaacaagttagcctgccactatttcatggaggctcagcaaatgggaaactcctgggtcaaagacaaaggctttgatttctcacaccaccagttccctacaccccagttccccagatcaatgtgaagagggccagatgacacccgcatatgcattgagttgcattacaagtgaggaactctgaacttagggaacccgaatcttttatattgggcaataaaggtgtgtgccctttgctctagagacattgtttttattattttgagcagtaaacattcttgctgtttgttccagagggagacactatctctatcttccaaggctatgaaacattcaatccttgattacatagtctggaacaaggaaatttaagagactcttagagaattgtctctcaacagagtttagcctttagtaagagcttggacacctcatccattttaaatggtagagggtgaggggtggggaagatagattattggaaaagattctagtacctcttttttgcttacttttatttttttccctagcaaatcaatagatgaaggtatcaggtaaaatttaggagtgggcatcaagagtatatggtttaaagagagatagagctgcctagaagagaaggagagggttggccaaggaaatgtagaattattgggtactgctgaagacactcctatagtgtgtgatcataaatttaaccagtcaacacaattgcgattgttttatccaggttcatttcatgcttaagtgcagggaaaggtcacgcagagagttggctttaaccaagattggagtttttttttaggacagtatgatggagaaagaatgtggtaagggccttaggggctgtacactgacaaacccttaattagtatgaatacagtcatggaccatggaatctaggctggataaaaaggacagtgaggaaaggaagccccatgaaaaattgatgaggccaaaggatcagagttcctgctaggattaaagaagagttagagtgtattagaataagtgaactaggaagatagaaggaggtagtcaaataatggaatgcctaaaatcaaggttttagagtaatagtatatgagcatgggagtgggtagctaaggtggggtggagaaaaagatcattagagatgaggagtcaagaaactgaatgaccagagtgtcagatgtatcatttagtgcttgttgaagtcaccaagaataacaagtcacagtggagagacagggacctgtatgctaaaattttgaatgaatgagaggaaatgactgaaaggtcagtagatgattgcaacatagaggggtggcaggtgccattgactgatggcaaactattcctttatttaataaatatttatttacatatggccaactaattactgtggggagaacaacttaccacatcctcaaggattacatgctaattggaagataatatactcctccatcaaaaacgaaacagtaaggcaaacattgcagtatggtgaggcagaaataccacttgcctaagggtcagaaaatccgatttctattataagttccagctttgtcagtaattagctgtgagcctgggtaaatcagttaacctcattaggcctcagtttccacatttggatacagatgagatgattctcaagcttctgcagggcataacatttcataattctatgaaataaaataatagctatttcacacggaaattggggagaataaataagcacgactgtccagattttacagacagaagaacatgaaccacaaaggactacataatttgtccagcatcagaatgtaaagtcaggttcattgttgtttgtgttagatcatataatgcagagcagatggcctaatctgtgttggtgtttgtccactttcctaaatttttgtttgtctttccgttatctctatttggttctagctaggtcatgattgcttatgtcaaagaaacaaagaaaatacgacaagaatctgtaactgtaacaatgttgtttaacacaactttgaatacatttttacaggaagcaaagaagtgtgttgccctctaggaaatgtgtgttgctctgatgtaattaggttgacatacgtttccctggtagccaatataaggaatgggtccactaacccttgatatcagaaaattctggggttggattagatgtcaaggttgggaaggatattatttgggtaaaggggttcattaacagtttttccactataatgaatttttcctttatagctgtgatgttactcctacatttttgaatatgtacaagcatattcagtgatgctttgagatccaactgtatgctgggtactactactgtaaggactagtggctttgtggagagcaagagagctaaggtatgcgtcctatctccttttgttaatatatactgaatggcaaagatagacataaacaagaaaatgaataaataagatattttttcagagcatgatcaacattatgaagaatataaaacagagtaacaagatgtctcttaccatgttttgcattccccgcatttagaaaataagtaccacaagagttaggaccttgtctgttatatttatcaattatccactgtgccttggttagtgagttttggctgtggacttctttaggtaggacagtcagaaaaggtatctgtaagatgccctgagagctgagaagtagaaaataaggaattttcagccaaagatctggggaagagcaatgtaaaattcccaaggaagcaacaaattcagcatgtttaagaaacataaggaaggtcagtgtggctggaaagttgtaagggtagaagtttgaattttaatttaattactgtgataagccactataggtttttttttcctttctttcttttctggtcatgttttcttcctctaattttatttccttttttctctaaagaattttagtcagggattttaaatgaccttatttttatctttaaaagtttacccagacagttttgtagggaatagagtgagaatagcatgagaagaagcaagagatcagttaggagatgagtgttgataatgggctggtgcaggggaagaagtattgagcagtaattgagtttgagatatattctagtaggctgtgtgtggtggtgctttgggaggcccaggtgggaggataacttgaggctaggagtttgagagatacattcaaaagatagaacaaacaggatcgttcagctgttgttcttcaactgttgttcgacagctgattgattggatacggagtgagagaaaaaacaagaaagactccattgctttggtctgagtaatttggtggtagtagtgccactaacagggaaactgggagaggagcagagtttttctagggaaaatcaagcagttggttttgtccatgtgaagcttacagtgcctgttagatctccaaatggatatgtagataaaatggttgatatatgagtatggcaagatgtcagaactgaagatattatcctcctgtgagtcattggcatttagatgctatgtaaagctacaagactgagtgagctcatcaagggagagcatgttgatatgagcagcaaggactaagccttgaatatttttgcctttgaaaaatacagtattctatagactagaagtacattatttaccaggcaaatcagccagttttaaaaacccactttgtcttcctctctcagcaagtagtgggaggccatcttagaaggaagctatcctggtgagaagctctaatcacacagcagcccctgggacttgccagtatgtcatcagatacacaaagaaagattctggttccactatgcctctctctcatcctaagtcttccctgactctcccaggccacagtgatccctccttctcctaactcttcttcctcgttactttctggacctttgcagactttcttcctggtggtgtagctacttatgcagagcagatgctctaatatgtgtctgtttatctctatttatacaaagtttgtatttgtcttcttgttatctctaactaggcaatgattgcctatcacccccgctttcaacaacattataatttcctcaaggacaggatattcttacatgtctttctatcccttatcatgttctgtatttccccatttggaatgtaaataccacaagagctaggattttgtctgttatgttcatcactgtactcttgcagtctgaaacagtattcttgaataaacgcaaatagaatgaaggaatataaaagctgtttatagttgtctagacagatgataaagtgccctgcctaaaagcaagacttttacccttttccttggtagacataacctccacttttggtccccttttaacaccaccatatgcagaagtgtttcacttcatatcaccttcatggaatcttcccacaggttctgctgatgctcaagtaggtaagaataggacatatatttatggtctgtagaatgcatgtatgtagttgggatctgtggtagattgtctgcaaagatgaccatcaacaatttcgttcatctttgtatatgtacattgctcttcccaacaagagatggagtctgtttcctccccacttgaatatagatggccatgtgactagctttggctaatagaattcagtagaagtgatgttaatctaactttgggacctggaccttaagaggccttccaacttccagttttgctgtcttgagatttgggcaccatgtttaagaagcttggccttctggatgatgtaagaccacatggagagagagaagcctagctagcacccaactattccagccactgcaagtgaggtgcaaaacatgtgaataaagccatcttgtattctctagctctagcgaaactatcccagcttcctcaggagtcacgaagcagccaccccatgaagcacagacaagccattcttgaggagtcccaccttagttgcacaatcatgacaaataatacttttgggggtgatttgttttaagccatacttttgggggtgatttgttatatagcagtagataactgaaataggatctgtttcaggatttcttttatgataaaacttccagaaatacattgcatttaaaagaagcacttctgcaatttgtagcaaaattatgatgcaattatattttgtcccagcagtcttccttctaggattctatcccaaagatactctggcaaaaacacaaagagacatattggctattcattgcaatactacctaaaatggcaacaaactttaaacaattcaaatgtatatcagcaggggactcgttgaatatgttatgtaacatctacatgatgaagtaatatgcagctatagaaaaggaatgaggaacacctctgtaaactgccgtagagtaatcaccaaggtataaagttgaatgaaaaaaagcaggcacagaaaattatgtatggtatgatatgccattgtttaacttttttttttttttttttttttttgatactgaatctggctctgtcaccaggctggagtgcagtggtgcgatctcggctcattgcaatctccaccttctgggttcaagcgattcccctgcctcagcctcctgagtagttgggactacaggcacgcaccaccactcctggctaattttttgtatttttagtagagacggggtttcaccatgttggccaggatggtctcgatttcctgatagcgtgacccgcccgcctcagcctcccaaagtgctgtgattacagacgtgagctaccgtacccggccgtgtaacttattttttaaagaaaagataaaatataaaaactttaggccgggcgtggtgacccacacctgtaatcccagcactttgggaggctgaggcggatggatcacctgaggtcaggagtttgagaccagcctggccaacatggtgaaaccccatctccactaaaaatacaaaaattagccaggcgtggtggcgggcgcctgtaatcctagctacttggcaggctgaggtaaggagaatcgcttgaacgcgggaggtggaagttgcagtgagctgagattgtaccattgcactccagactgtgtgaccgcgagactctgtctcaaaaacaaaaaacaaacaaaaaaaaagctttaaaagaagttattaccttaaggggagggagtggatggggtaaatgataacacagaaatataatcttaaaactctagactgtccccgcccctggcctgcccagcccgcggcagcagcgtggccgcggtgcagcatcagcatcagcagcagtagcagcagcgggcggccgcgtgggtgtttttgtcgggtctcggggtctggcagcagcatggcggactacctgatcaccagcagcaccggctacgtgcccagggatgggctcactgtgccccagctcttcgtcggcgctgacggcctcacccacaacgacttcctgattcttccaggattcatagacttcatagctgatgaggtggacctgacctcagccctgacccagaaggtcacgctgaagacgccgctgatctcctcccctatggacactgtgacagaggctgacatggccatcgcgatggctctgatgggacctattggtttcattcaccacaactgtaccgcagagttccaggccaaggaggtacagaagatcaagaagtttgaacagggcttcatcacggaccccgtggtgctgagcccctcgcgcactgtgggtgatgtgctggaggccaagatgcggcatggcttctctggcatccccatcactagacgggcaccaagctggtgggcatcgtcacctcccgagacactgactttcttgctgagaaggacaacaccaccctcctcagtgaggtgatgacgccaaggattgagctggtggtggctccagcaggtgtgacgttgaaagaggcaaaagagatcctaagtgtagcgagaaagggaagctgcctatcgtcaatgatcgcgattaactggtggccatcatcacccactccgacctgaagaagaacagagactaccctctggcctccaaggattcccacaagcagctgctgtgcagggcagctgtgggcacccgtgaggatgacaaatactgcctggacctgctcttccaggcgggtctcaacgtatagtcttggactcgtcccagggaactcggcacatcagatcaccatggtgcattacatcaaacaaaagtacccccacctccaggtgactggggggaacatggtgacagcagcccaggccaagaacctgacgctggtgtggatgggctgctagtgggcacgggctgtggctctatctgcatcacccaggaagtgatggcctgtggtcggccccagggcactgctatgtacaaggtggccgagtatgcctggcactttggtgtgcccatcatattcaatggtggcatccagatcgtggagcacatggtcaaggccctggcccttggagcctccacagtgatgacgggctccctgttggctgccaccatggaggcccccggtgagtacttcttctcagatggggtgtggctcaagaagtaccgtggcatgggctcgctggatgccatggggaagagcagcagcagccagaaacgatacttcggcgagggggataaggtgaagatcgcgcaggatgtctcaaactccatccaggacaaagggtccattcaaaacttcgtgtcctacctcatagtggacatccagcaaggctgccaggatagcagggcccacagcctgtctgccctttggtccatgatgtactcaggggagctcaagtttgagaagtggaccatattggcccagatcaagggtggcgtccacggcctgcattcttaggagaagcggctgtactaaggacagcggtggaggtcgaggtggtggagggggtgcaccccagtgtccaccttcgggcactgcctccctccataactgagtggtccacagatttgcactacaggttccccagctcctttccagcgagagaggaggggaggtcctgaggggtctgcagcccctcgctcagcatcccctgcagtcaggacttttccctgggccaggctgccctgggagccccctgagcccagccagccagggtctcaggtgcctgcctcaggtctttcttgctgcagcctgctccagcccggcccccaccctggggggcaggcagcccctcctggcttctcctgtagagcacctccctgcccccagccccccaggaaatggtgctctcctggccctgcctctggcccttcccgggccgctgccccctcagccatgtggcacttcttagctcctgacctagaccaaggagtggtctctgcccccttccctggccctgggctacccttgggtcctgctcctcaggcagctcccctgtccctggccctggggaggaggctgccctggtcatggccacctgcctgtcattcctgactcaccaccatccccaggtgtaccattcctgccttctcctcagccgctgttgaaggctttaactttgcatactttgggatcacagttgtgtcattgtgtattaaataattggaataaatcaagcaggtctcaacgcctctaccaaaaacaaaaacaaacaaacaaacaaacaaacagaaaacaaaagctctagaactctagactgtgggaaactatagcacaaataacctagtttctcctacaagtaaaatttaaagaaaacaaaaagggatggaatgggaaccttgtgattaaaaagaggaacttaaggggcattctaaccaattgcaatttatgaaccaatttgttttccaatttgaataaataaactgaaaaagtttgagacagggaaatttaaacactggttagacatacaatgctattaaggaattattatttaggtatgataatgatagtatggttatatttttaaaagaagctttatatattagacacacactgaagtttttaatggatgaaatgatattacactaggaattgctaaaaaataattagatgaattagtgaagttacggataaaacaggattggccgtgagttggtaattaatgaatctggatgattggttcattaaagttcattctattgtcttctttacttttgtatatagagtcatcccttggtatccatgggggattggttccaggaccccctgctgataccataatttgtggatgctcaagtctcttatataaactagtattatttaacctatgcacatcctctggtatactcaattatctctagattacttataataccttatacaatgtaaatgctatataggtagttgttatactgcattgttttttaatttgtattgtttttgttatattatttttattgttttttgaatattttaaaaagtttccatttttttgtttttattattttaattgacacacaagaatcatacatatttatgggatacagtgtgatattttgatacatgtatacaatgtgtaatgatcaaatcaggataattagcatatccatcacctcaaacatttgttatttctttgtattaggatcaaatattttccattcatggttgaatctacacaaaagcagaacccatggatacagagggccaagtgtatttgaaatttttcaaaacgaaaagttaaagtaaaaaggaaagcctctgagacccagcattttaagggcactgaattcattttcttcacagtatcataccgtacatctattactccaagtaaaccccatctatataaaatggaagttatatctgtaaaaccacgatgagtatttggaactgtctgtgattgacatcatgtcagtgattttgaagttataatgaattttcagaagacaaagcgtttttgttattttgctttgttttgggcttttaaaaaaaaaaaaattccagtgtcacttttgtctcttagtaaaagttttacagttttaattaccatgaatagtctttctcctcttccaaacatgtatcatcattcattcactcaatcaacatgttcttcttttttttttttttttgagacagggtctcactctgtcacccaggttggagtgcagtggcacagtcacagctcactgcagccttgaccttccagcttcttggctcaagtagtccttgcacctcagccttccaagtagctaggactacagacatgtgccaccatgtccagctaattttattatgtttttgtagagacagggtctcactatgttacccaggctggtctcaaactcctaggctcaaaccatccttctgttttggcctccaaagtgctagaattataggcgtgagacaccatgcccagccttaagacttgttttttgagtgactacttttagagctgctggtattaggaaatggtgctgcgagctaacaggagtctgcagccctgcagcacacaactgtcaacatgcaagcccagatgcttacagtaccatggaataacagggctataattgaggtctttgaaaggacatagaaagggcctggttgctcttcccctagcaggagatgggaggagaaatcttgaaaggggatgttagagcctgttaagatgctgattctggggaaagaataccagcagactgggtatagcttattttggagggaagatgtaatctgatgctttttaggttacaaacttctttcattttcaaatacctgttatctcttctctgaaccaaaatgaatgacctatatcagtggttctcaaagtgtgatccctggatcagcagcatcaccattcccaggaaactggctaatgcaactgctcaagctccactccagacctactgattctgcaactgtggagctgaaccagtgacctatgttttaataagccttccaggtaatgttaatacttgctcatgttagagaatcactggtttagagaaaactagtaattgttccataaatttagtttaaagaaggagaaagaagcctgtcctttagccaagtttaaaaaaaaaaaggctgattacagaggaaattttgagagcatctaaggttaaaaaaaaaaaagtttagcttggctggaggcctggcagaacagtcgttgtggagaaaccagtgcttcacagagagaaccgcaaacactaaactggatagctgctgtctgccactcaggagcaagtgcagactagagacttatggaggtctccagtatccttctctgagataccaatccttaacccaagaaatccaaggccaatagctaagtataaaagttattctctgagagtgagaatacctagattagggataatggataataaagctgtatgaggccaggcgtggtggcgggcacagtggctcatgcctgtaatcctagcactttgggaggccagggtgggcagatcacctgaggtcaggagttttgagaccagcctggctaagaaggtgaaaccgttcctactcaaaatacagaaattatccaggcatggtgcgtgactgtagtcccagctactcaggaggctgagacaggagagtcccgtgaatcggggaggtggaggttgcagtgagccgagatcgccctactgcactccagcctgggagacggaaccagactccgtctcaaaaaaaaaaaaaaaaaaaaaatctgtatgatacaatttttgcaaaaacttgtgtctatttcttttaactttttaaaatgtggctactagaaaatgtaacctatgtagctcacattcgtgacctgtattatatttcttttcacactgatctgtaaggcacatataaaatggagggtgggtaggagaaaaaaactgaccatttttcctccaggtctgaacagggcagtgggtgttcagaaccacaaatcatcatttcttatttctgtgtcatttgtatttatattgtgaagataactcagtaatatgagccataaaaattatatagcaaacatcttttatatccatgttcacaaagcagtttttcaatcctagaaattagactttccatcacgggagcatgaattgattggtaaaaactagaacatatactaatacgtaccaacaatagccactcccacttctcctaccttcactaggtcagacatagttaatcaggacattttttatttttatttttttaattttgtgagtatatagaaggtgtatatatttatggagtatatgagatgctttggtactggcatgcaatgtgtaataatcacatggtaaatgggttatccataatcaggcctttttttctacagatctcagacacagcatcaatgtccttatcatctctgctctaagaagctatgtagctattgagggatgcagtcatgatacaaaactaggtctgtttgactccagagactgcatttctttcctacaccatgcagatttccacttaataacaggtgcacatttatagttttatttctaattcagataaataaactgaccttctgatttataagccagtgtcttattaatttggttgatagattttatccctgagagatcaaataccttttgatatgctggcaaacttgaatatctgaccctgacaactgagagcaggactctagtccaggaatagcctgtgcagagcacacatgctcactctcttctcccttaactacagtagacatcgaaaatcaatttctgttgctcttttgtgttgagcctagacatagcctcaaaatactttttaacacagtgctctagaaagctactgccagttgacctgtgagaccctattgatttgctggtgtggatgatagtgacctaacaaaactgcttttctcaacatccagctggctttcctctggtgaatccctgtccttattcccttcttgctacttcccagagagtagataggttctaaaaccaatccagaaggtttgtgtacctgaggaaagtttgggaacctgaggaagaaaaatggcattttaggaagtctagactcaataggatgggaaaattcctataacatgttttttgggttttccagaagcaagctctaaacaggtttctacacaggtctgtttaaattctattacgatctgtgattttgaactcaacaggagtatggaatttaccacaataatagtaataataattcctgtaccagttaggattattttggctgcaaataatagaaattgccccccaaacagtagcttaaacaagatagtttatttttcttacatgtaagtaactccagaggaaggcaaacccagacttgtatggtgactctcaagccattgagaacacagatcccttctatcattttgtcattttaaagtatgtagaatggccaaccttccatttgtatgtcaccttatgggcaaatgtggctgcggaagtacatttgctgtgggaaggaagaaagaggaaggacaagaggatttatccagttctgtcctaagaagttgtggtaggctgaataatggctaccccaaatatgtccattctaattcccagaacctataaatatgttaccttatatgacttattagtcctttttcacactgccaataaagacatacccaaggctgggaagaaaaaggtttaatggactcacagttccatgtggctggggaggcctcacaatcattgtagaaggtgaaaggcacttctgacatggtggcggcaagagagaattagaaagacacaaaagcggaaaccccttataaaaccatcggttctcatgagacttattcactaccacgagaacagtatgggggaaccacccccatgattcaattatctcccaccctggagaattatgggagtatgatttaagatgagatttgggtggggacacagagccaaaccatatcagtgacaaaagggactttgcaggtttgattaagttagagatcctgagatggggagattatcctgcattatttgggtaggtccaatataatcataaaggcccttatcagagaggggcatgaaagagtcagagaagatgtaaagacagaagcagaagttggagtgatgtggggctgcagccaagtaatgcaggcagcctttagaagctgaaaagacaagaaaacaaattctccctaaagttatagaaggaatatagccctgatattttagacttctctgttggttaactgtaggtgtcaactttgtcaacttgactgggttaaggaatacccagttagttggcaaagcattatttctacgtatgtctgtgagggtagttctggaaaagattagcattggaatcaatagactaattaaggcagatctgccctcacccaatttgagtggacactatccaatctgttgaggactcaaatcgaacaaaaagacagaggaagggtgaattcactctcttttctggagctggtacactcatcttctcctgcccttggatatcagaactccagattccctggccttcagactccaggaattgtaccagtggttcctcagtttctcaagtgttctgcctgaaactgagagttataccattggcttccctggttctcaggccttctgacttggattgaactataccaccagtttccctgggtatccagcttgcagatgacatattatgggacatctcaacctccataatcacatgagccaattcccataataaatctcttctcctatatctatctatctatctatctgtctgtctatctatctacctaactacctatctatcatctcaacctccataatcacatgggccaattcccataataaatctcttctcctatatctatctatctatctacctacctacctatttatcatctcaacctccataatcacatgagccaattcccataataaatcttctatctatctatttatctatctatgtatcatctcaacctccataatcacatgagccaattcccataataaatctgtcctatctacctatctatccatccatccacccatccacccatccatccatccatccatccatccatccatccatccatccatccatccatcatcctattggctttgtttctctgcagaaccctgactaatactgattttggtaccaggagtgaggtgttgctatagcaaatacctacaaatgtggagtggctttggaactgggcaataggtagaggctggaagagttttgaagagcatgctagagaaagcctatatagccatgaataaactgaaaaggtgattcttgtgggggctctgaagatgaggagagctgtagagaaagcctcagttttctcagaggctacctaagtgctcatgatcagactgttggtagaaatatggctgataaaggccattctgatgagggctcagacagaaatgaggaatatataattggaaacttcaggaaaggcaatccttaattatgaagtgacaaataacttggctgaattgtatgtgtcctagtgttttgtaggaagtagaacttctgaatgatgaaataagatatttaatagaggaaatatctaagcaaagtactgagggtgcagcatgggttctcttgactgcttatagtaaatgcaagaagagggaaaaaattttaagatggaatttgctatcaaaaaggaagcgaaaattaaagatttggaaaattctctttctataaaaaaatgagaaaatgtattcaggagaaaacaccaagggtgtagccaaacaaacatttgataaggagattggtatggatagaaggaagacagatgatgttcatcaagacaatgatgactgatcctgaaaacatttcagagatctttggggctgccctacccatcataagcccagaataccaggtccttgagggcagaacaatttcaaggctatccttcttgaaattggagccaccaatgtgcatctccagcctggaagagcctcatacatcagactccaatccatgagagctgtctgtcacttgagcaggaaatacatgagaacagggccacttggagccttggggacccaactcccactcccatgtctctagaaggtgagacatcaagtcaaagaagagtatttttcaagccttaagatttattatttgccatgttggattttggactaacttgggaccagttacccctttcttcctccctatttctcccttttagaatgggaatgtctatcctgtgcctgtcccaccattgtattttggaagcacataacttgtttggtttcgcagactcacagctggaggggaatttgcctcaggataaactgtaccttgcatctcactcatttctgatttacatatttggatgagactctggactttagacttatgagttgatgctggaatgacttacaacttctggggctattgggatgaaaaaatgtattttgtatttgagagaacatgaatcgggtggggaggcaggggtggaatgctatagtctgaatgtttgtgtttccctaaaattcgtatgttgaaacttaatccccaatgtgatagtaataagaggtggggacttttggaggtgattaggtcatgaggacttagccctcatgaatgggattagtgcccttagaagtcaagggagcttgctcaccccttctaccatgtgagaacacagtgaaaagatactattgatgaagaatggagcctcaccaaatactgaatcacctggtgccttgatcttggacttcttagcctccagaactatgagcaatgaatttccgttgtttataagtttcccagactaaagtattttgttatagtagcccaaatgggctaagacaacttctgaccgccagaattgtaaaataataaatttgtgttttagtaagccaataaatttggcaattcattacaacagcaataagaaaggaatacaggattctttccagaagtccctcttaataattcccattgagaattgactagaatttatctcattggctagaattaagtcaaatgcccacaaatggctgcaaaagaacctagaaagtataatctttacctaggcatattgagaactccaatatgacagtaagttagtgagaaggaagggaataatggatggtgagtggacaactagaaacttccaccagttattgcttagggaacccttaatatgagcccagtactttgctgagcattttgcatacattctattatttattcatcatcctaggtggatagaggttttctttattttactaatgactgtgcctgtctcaccattgtgtggaaaatgtctctaaaaaagacatttagagggaattacgtagtgagctcactagattatttactgttggagaacaatgactgtgttactgttttactttttaagaccagcaaccattttatagtggggacacaatgaatgttgattggatatgaaattctaaatgccaatattttatcccagatctgactccaaagcccaagttcctgtgcacacatacatgctctcttctttctctctctcttgctctctctctctctctcattctctctcttactcttttactttctcacactctctctgctgtatgtgtgtgtgtgtgtgtgtgtgtgtctatagtgtatgtgtttctacagtggacatgctattgacaccgctgccattcaagaaacttttaagtgtgcattagaaggcaaatttatcaacatgtattagtggttgtgacaaaaaagatgatgtccaagaggaagtaacactggcaaaagcatcacattaaaggaactctcaaggatacttcatgttattgaaagtgcaaaggataaaatgttggacactagtacaaatatagaaaggatatgacaatttgccaaggcatagaaaagatgctctgaaggtaggcactattcaaactactcttgacaagatttttacaaagcactttaattatcaatgtttctaatgttttaaatcataatctattaaataaatgttagttttgctattttagaaatatccctatacaattacaactgaaagtaagagaatttttaatgtttgggccagaattttttggaccagttataatttttcctatgattattaaaatcgctttgcacagtgtctccttgcatggtcatctgtatgactctgcactatcatgcaaagtgaggactgcctggttatgggtaaaacaagaaattcaaaatgatggaatcatacttatgttttagcattgtaagtgtattttaaagtataatgggagtttggaaaatgataaaaggtacaataatattgtagacacacctgtcaatgcataccagtaactcacatagctattcggtggtgtatgacacatttgagacagagattatctgggtattcatttgtctggagagagaggacaggtgtgaatgaccatattatgtctcatccttggaaaacatggcagctaatgtcaacctctcttaaacatttgctcccttgagtcatgagtctgtaccaattagaaggccattgggtgcaggtaccttaggacaccagctcctcttgctggtcatttctcttggccctgctatctacttgcatattggctcaatttcaggctggcagctcatcatgacagctgtaccaggtattacatcccaatggtgttagggactgtcttttttccagagtctcttcaggagtaaggagaagcctgctatggttttgatatttgtccactccaaacctcatgttgaaaattgacccccagtgttggaggtggggcctaatgggaggtgcttgagtcatgggagcagatctctcatgaatagaatcatgctgtcctttaagggtgagtgagttctcactctcttagttcccatgagagctggttgttagctgggtgttgtggtgtacctgtagtctgaactactcagaaggctgaggcaagaagatcatttgagcccaggagttggaggctatagtgcactatgattgcacctgtgaatagccactgcactccatcctggtcaacacagtgagaacccatctctaaaacaaagagcttggcacgcccctcaacacacatcagttttgcttagtgtcttgccttgtgatctctatacacactggttcccctttgccttccaccatgagtggaaggagcttgaggtcctcaacagatgcagatgcccaatcttgaacttttcagctgtcagaatcatgagccaaataaacctttttttcttactcgggctggagtattcctttatatcaatgcaaaatggaccaagacaaagccctccagccaatttccactccacgtggccactgtagcagtcagagttcaggatgaaaaactaaaatgactctatgcattctggatgtaaaagggcccctaattctttatatagaattaatggcatacactactgctcagagagtagaatatgaggataaggttcaaaagctctattcttgaatgtcagagttgctgaccctcaaagatcttagcctggaacacctaggtgcatattaatatttcctgaagtttgtgccaggaaactactaggaatttctcatttgccctgctatacagctataaccatatccagaggaataatgtccttctctttccaaatcttgcctctgttctcatgagtaataacctggaacgagacagagatggtgattctaggacgcctggtggtagtactttgctggcagcagaaaaattcagcatactcacctctaaaccagccccagcaaggggaacaggccactgggattaccttaggcccatcacaatttacctttgatcctgaaggtagagtgtggcactctcacctgtgtcacatggggaagggttgaaacccacccaattcagggcttgactagtaaggaaaacaaagaaaaagctgttggttaaacaagcagcagagcctactgcatactatataacaatataatcatcattttatttgtaaataaatatatatgttaccaaagtagctagctatatagtttaaagaaatatgctgtatatggctgggcatggtggctcacccctgtaatcctagcactttgggaggccaaggcgagtggatcatgaggtcaatagattgagaccatcctggccaacatggtgaaaccccatctctactaaaattacaaaaattagctgggtgtggtggcatgcgcctgtaatcccagctactcgggaggctgaggcaggagaattgcttgaacccgggaggtagaggttgcagtgagccaagattgtgccattgtactccacctggcgacggagcaagactccatctcaaaaaaaaaaaaaaaagaaagaaagaaatatgctgtattacattgaccatgcatacctattattacccacaaggtacaaactcctgcaagttgttcaggtttcaggctaaactgtaaaactaaagtcagctgattgataatttatggtattattgtattctgtaaaaaggcttcttttagaaaattcctctattagctcttcttcagataacagaacagatttattggtctgctgcttttatatatgccttgccagcaccccagcagatcctagatttaatgaatttatttgcgtgactcaagtttacaagatcagccatcccttctctctgctgctgatcttcctgatctcatttggctgccactttacatcccagttaattccatttcagtttcctcagagactgcaggaccagtttttccctgggaaaaggaaagctgatgactgtgagtccatttgggggcccaaaaaacagaatgcagatgtcaaaggtgctaatatctgattttctcaccaggactgcttagactaaatcctttgtataagaaagccacaaggacaagcctttttggagggtatcaggatagttatgtatgtgcaggtgccagggagtggcttctgttctagaagggccccacagctcagcatttcctcccacgtgctttcttgaatatgcaagctgcatatatatttataactctgcaggaaaaatgtgaactttattaacagagataactgtcataattcaagcagttgcactctatagagcaaccagagactacaggcatcaggattatgcatgttcagtaaaattatatgcaaatgttggggaattatgagatactaactagggatgaatgaggaagaaggaagggctagagttgaccgtgcctgtgggggactgtaggagtctagagaacatgtctgagtgctcttccagggaatgtatatccttgagggcagtaaattcattatgcatttttgcattctcccatcctagtagcaaccctcaataaatatttgttaagtgaaggagtgaatgaaatgttgaccttggcaatgcacaataacttctgaattggtctatgtgtatgcacatttcctccctttcctatttaaacatttattctaaatcagtggagccacagctgtccaagttaagagtcatacttacagtcattattaaccaagtgaggttccaagccagtggttctcaacattggctacatgttacaatgacttagggagcatttcaaaattccagtgctcaggcttcatctcagactagaaaaacaatctctgagctgaggcgcaggcatcagaattccaaggctgagtaccactataagctagcatagaaactgccatatctgtggaattaggagacctagaagaaatcccacagcacaaaaaagtgctagtgccactttcactgatgttcaaagtgcagaaaagttggggaaaaaattctgatgggagttagaaatgtgtttcatttatttattgtattgtatttttttttgagatggaatcttgctctgtcacccaggctggagtgcagtggcatgatcttggctcactgcagcctccgcttcctaggttcaagccattctcctgactcagcctcctgagtagctgggattacaggcgtgggccaccatgcctggctaatttttgaatttttagtagagttggggtttcaccatgttagtcaggctggtctcgaactcctgacctcgggaaatctgccagcctcggcctcccaaagtgctgggattacaggcatgagccactgtgcttggccaggaatgtgtttttgtgctcatctggaacttgaggactggaaggtgagtcacatgtctaggaatacataacacttcaaacaacaaaatgatgccacactgtgaaaagagatgggaagctattgaatatccctgtcctgccctggctggtgacccctccccaacattcaggctgcaggaacacctgagctctggggctctctgcctgatacccagtggtggccttatttattccactgccgagttctttctggcaaccttgtaccattcttgggaaaggttggggaagcaataggtaaatgttgttttggtttgtagacatcttttggtggggatgggggagcagctgtgctggaactgggggaaggggagctgtgactcaggggaaattctaagttgctacaagctgcagcaagtgtgtgtcagtgggaggtgagaaaggcaaacagagggctgaaaactgagccaggaacctgcctagtggataatcaaaactcgactataaataactaatggaacgacgaacgtgtttagtgaagttattttctaaagcagcgtacaggcaaaatgagtgctttcctggagcaaatcctcaagctgttccagaagggtgagtaaaaatacagaaacacctgtctggcagtggtgattttacataaataatttttccaggtaactgaaagctaccttgtaaatgccaaaaccctgaacattttagttgtgtaagggaaatttttctaaaatgggttatattttctccagaggtggcgaacagagtacatttcatttactggcttttggtggttcaggatttggtagcagaacctggatttccttcttcaccacccttttcactcaccttcagtttcagctccaggcatggagcatgagacataggcttaaagccatcaatgtctcctttcgcttggttacaggtgatgggctctaatgcatgggctttgtgacaactatctccccttgttttgagcccttttctggctcccatgcactcagatatgttttggatagatatagtcactgtgagtctggcctctgtttatgagagttactgaagtgaatgtattttattttatcttattttttagtgctcttaaaattcactttggttttttaatatttttaaaagactcatgagactgttcatatttcatgacctgcgactatactaaggagaaacagctcagaaaactaatttaaaataattcatacctaattgcggtctcatttctgaaaatattttgcacacaatcctaccctgccctggtaccctggacatcacaaagagtggcacaacgtaacataagataccataccatgtatccagcaatcagcttttatgagacttgcatcattataaacctataagaaaaaagcctgtgcattatggaaaaatttgcacaaaactctgtgtacctgactcattgtgaacacccaatcccttaggcctaatggtttgaaatagtgggtgaagcaaaggccaatgatgggtcaaattcctgtatttgtttcattgctgaggtagtgaagggaccagggatggtgtcagaagctaccacatcaagatgtgagagagaagcagcagccaaatcacacgccagctgtagagatgccagtatggggaagattgccccatgagcccaccaggtcctgttttaagggcatcattactgtaacccagaatgataaagttcacaattgcaaccttgtgccgttaagagaagtctacagtgatgcccacatggcttttttctaaggtagataagtgtgtaatatcttttagaaaactttacattctttaatgattaagtatgggcatttattatttatttatttacttatttttactttttattttagagatatggccttgctctgtcacccaggctggagtacagtggcacgatcatagctcagtgcagcctctacttcctgggctcaagcaatcctcccacctccacctcctgagtagttgggactacacatgtgcaccaccatgcctggctatttttaaaaattgtttatggatggggtctcactatgttgcccaggctggtctcaaactgcaggcctcaagtggtcttcctgcctttgtctcctaaagtgttgggattacaggcatgagccactgcatctagccaggtatggacatttaaagtggcaaatttgtccagacgcgatggctcacacttgtaatcccagcactttgagaggctgaggcgggcagatcacgaggtcaggagttcgagaccagcctggccaacacaatgaaaccccgtctctcctaaaaatgcaaaaaaattagctgggtgtggtgcaggtgcctgtaatcccaactgctcgggaggctgagacaagagaattgcttgaacccaggaggtggaggttacagtgagccaagatcacgccactgcactccagcctgggcgacagagctagactccatctcaataaataaacaaacaaacaaacaaacaaagtggcaaatttgaaatatctgggaaaatcacttatgcagatttcttcaatttgaattaatagaatggaaaatgaaaaagagaagagacaaagctttcagttgcagttgtgttattaactagctgtgcaatctagaagctccgtttgcttatttttaaactggaaaggccttgatttatactgtctgctgtggtagtcacttgctacatatggctatttaaattgatttcaaataaatgaaaattatgatcaaacacagatacaggaaaactgaggtaggaaattaactgaaacaaaagttatcagtttgggaccataggcaacagctataagaatgctgaggtagggcaaaattacataattagccagagagagcccagcctgaaccagtggttaggagacaaatgagaaggtgtcaaaattcacacaacatgacaagtcagaaagcaaggcaatagatcaaaagggttcagtgtaggcacaggaaagaccttgcttgcttaagaccagcatggtatgaatgaaagaattcggaggccacgatgtctcctgttaaaagtcctccctccataatcattgtggtagacagactagaccctagtgtggtttcattttcatgactctataatcccttcctcttagtgtgggtgggaccaagaacttgcttctaaccaatataaaatgtggtgggaaagtgatggaaagtcattttcatcattacattattgtattgatatataactctgtgtagctagcatgcattagaaagactctttacattgctcccttgaagaagtaagctgccacatcatgagagggcctatggagggggccaatggcaaggaactgcaggtggcctatatttgctgagagtggcccccaactgacatccagcaacaaaacagggcctcagtcctacaaccacaaggagatgaattctgccaatgacatgaagaagcttggaagttctttccccagtctagcctctgatgagcccacagccttgaccaacatctggattgcagccttttgagacccagagcagagggcacagctaagctgaatctggacttctgaactatggaaactgtgagataatgagtattgttttgagcctctaagtttttggtaatttgttatgcagcaataaaaaactaatatgtccatttaccatggtcaatcacggtagttttcaaggctttctttagttgtggagacctgtttttaagccaaagcacacatggaagcacaatatgtaaacaaagaaaggtagaatgtctccatttacagctgggtagaaggaatggatcccttcccacctgggttctcctgaacttacagggccacaagaggaaactctgtgaacagtctgaaaacttaaataaatggaagaaggactagaacatgctgacccagacacacatttcaggctgcagggaagagacacactcaagtgtccttccgtgatggagcacagtggataatgttgatgcactttgagaattctcaaatctctttacagtttctggttactcctccccagttgcagtgtgcttttttgccttcaagagttacaggtctgtacctgtaactcttcttatgagaactctccttgggttactggaactgtttgacctactataggtaactactatagttacagtaactgctgtatgacctcccttacctagagttgggactacctctggtgtgtaacttatactcccttctagccatatctggtggaaaccaccccagcctctctctgttggactgcctgaaatcacaccatacttggttttctcccttccctgtcttccttcccccacttccaacccagcttctgggaacacttctttaattattgctttgcacattactcctcatttcagtgcctatttcaaagaacccaacctgaagcatagagatttcctgggaagatacatggacacctgagacatctcaccatttctggtgcccagcgtttccaagtccctcattggtcacattcagtttgggctccagtgccctacctgcccttgtggttctggcatttatcctttccaaaggataatttgatcggcctgatgccaccatgcacaacaaaaatcctctaacgggtagagctttactccaggccacctcaaaggcagctgacccatttccacttaattgtctttagctcagccattgacccctgttcctatcaaagtggagtcaggatatccatgtggggtcattcaaatcacatggcaggagccacaggagcgttttgctgaaagaacaccttggggacattttcctcagaagagagtggtaggtgaggcaggtactttcttatcaactccctggagagtcctcttcagggcacacagcttttataactccaaagaggtgtgacactcaattatcattcagggtggcttgtggaagcagagaaagagtgaacaaggcaaggacacagtgcaaccagtctcaatcttgttcccgcaagattgaggatatggtaaatagaagtggttggtataaaactggatctgttctgaggacacagaaataatttcaaatactgtatttatataaatgggctacctaatatgctaaaaagaagcttatcaaagatgatgtaaatttaagagcatgagtcaattagtccattaggtttttaggttttgttttgttttgttttttgagacaaagtcttgctctgccacccaggttggagtgcagtggcacgatttcagttcactgcaaccttgcctcccaggttcaagcaagtcttctgcctcagcctcccaagtagctggaattacaggtgtgcacgaccacacctggctaatttttgtatttttagtagagacagggtttcgtcatgttggccaggttagtctcgaactccggcctcaagtgatctgcctacctcagcctcccaaactgctgggattacaggcatgagccaccgtgcccggcagtccattaggttttaaaaggataggcaaaagtcttcagaaacgtatatagaaatttgccctcagaacacttaatatttcagttaatctactgccatgtatccaactacaccaaaatttagtggctcaagtaacagctattttatttcccatttgtgattctgtaacttaggcaggactcagcaggggaggctcatctttgcttcatgcggtgtcagatgcggtagcttgactgaggctggaggatccacttctaagacggcctcaatcatatgcctggcagtttggtgcggctattgagagaactcagtgggggctgatggccaggaatattaattccaaattcttacatggttgctggcttaacacaaaagcagaagctgccaggccttcttaagcatctgactcagcatcacttcaattggctgaagtaggtcacatgaccagctcagcttcatggggaatagattacaagggtgtgactatatagggaggcatgagtgattgggggctaccaacataatagtctatcacatttgacaatgctgcaaagacattgcttttgtttattcagtctaaccactaactgaagagaaatagctaaaaagttaaatgtagataaagactcatctaaatttagataaagtgttagaccttaatgacttagtggctagggaatcttaaaggccctcaacagctcactggcgtggagggtactggaaggcatgtgtcacgtacttggaggtaaatggaagcttattttttctttatatctgcctgttcaggctgaggttcttttttttttttttttgagacagactttggctctgttgcccaggctggggtgcaatagcctgattatggctcactgcagcctcgacttcctggacttaacccatcttcccacctcagccactggagttagctggggctacaggcatgcgccagcacacctggctaattcttttgtattttttatagagatggggtttcactacgttgcccaggctgttcttaaactcctgggctcaagtgatccacctgccttggcctcccaaagtgctgggatgataggcgtgagccactgcggccatcccaggctgaagtttttgacaagggttgtcaatggaaataatgaccaggtgcagtggctcacacctataatcccagcactttgggaggctgaggcaggtggatcacctaaggtcaggagattgagaccagcctggccaacatggtaaaaccccatctccactaaaaatacaaaaacgtaaccaggcgtggtggtgcgtgcttgtagtcccagctactcagaagactgcagcaggagaatcacttgagcctgggaggcggaggttgcagttagcaaagagcatgccattgcactccagcctgggtgacagagggagactttgtctcaaaaaaaaaaaaaaaaaagaaagaaagaaatataatgtgagccacatgtataatttaaaattttctggtagccatatttttaaaaataattttttaaagttattaaattaaattaattttttattttaattttagctttttctgagataggatcttgctctgttgctcaagctggagtgcagtggcacaatcacaggtcactgcagcctcgacctgggctcaagcgatcctcccacctcacgctctcaagtagctgggtgcacaggtgcatgccaccacactcagctaatttgttaattttttgtagagacacagtctcactgtattgcccaggctggcctcgaactcctgggctcgaatgatcctcccaccttggcctcccaaagtgctgaaattacaggtgtgagccactgcgcccagccaagttaattttaataacattttatttaacaaaataatttcataagaaaccaacattgaaaatgttaatgatatcttttacatcatttatgtatttatttatgagacagagtctcgctctgtcgcccaggctggagtacagtggcacaatctgggctcactgcaacctctgcctcccaggttaaaggaattctcctgcctcagcctcccaagtagctgggactacaggcacgtgccaccatgcctggctaatttttgtatttttagtggagatgggtttttgccacgttggccaggttggtcttgaattcctggcctcaagtgattcacctgccttggcctcccaaagtgctgcgattacaggcgtgaaccacagtgcctggccagtatttatttatttttttgagacagggtcttgctctgttgcccaggagtgctgtggcatgatcttggctcactgcagtcccccaggctgaggtgatcctttcaccttagtctcccaagtagctgggactgaaggcacgtgccaccatacccagctaatttttgtattgatttttttttgtgtggagacagggtttcactgtgttgcccaggctactctgaaactcctgggctcaagtgatctgcccgccttggcctcccaaagtgctaggattacaggcatgagccacagtgcccagcctacattatttcaaaatactatatctttggatttcagtgtatgttttatatacttacagcatatatcaatgtagacactaaattttcaccagaaatatttgatctgtattaggtcttataaaatttacaattgaaaaatagattacacacccacatagttccaaacatgtttaaaagttttccaagccagacacggtggctcatgcctgtaatcccagcactttgggaggctgaggcaggcagatcacctgaggtcaggagttcgagaccagcctgaccaacatggtgaaaccccatctctagtaaaaactacaaaaattagccagccatggtggcgcacacctgtaatcccagctactcggggggctgaggcaggagaatcacttgaacccaggaggctgaggttgcagtgagccaagatcgtgtcactgcactccagcctgggcgacagcgagactaaaaaaaaagcgagtctcaaaaaaaaaaaaaaaagttttccaataacttatcagttttaaaaaattataattaaatgaaatcatttgcactagccacatttcaggtgctaagcagccacctgtcactagtgggtacaattttatttatttatttaagagagacagggctctgtagctcaggctggagtacagtggtgcaatcatagatcattgtaacctggacttcctgggctcaagtgaccctccagccttagcctcctaagtagctaggactacaggtgcacaggtgcttgccaccatgtgtagctaatttttttgggggggggatggtgtctcgctgttgcccaggctggagtgcagtggcatgatgtcagctcactgcaacctccacctcctgggttgaaaccattctcctgcctcagcctcccgagtagttggggattcaggtgtacactactatgtctagctaatttttgtatttttagtagagatggggttttgccatgttggccaggctggtcatgaactcctgacctcaagtgatccacctgccttggcctcccaatgtgctgggattataggtgtgagccaccgcacctggcgcctgtctaatttttaaacctttttttgaagagacagggtctcattatgttgcttaggctggtgggtaccattttagacagtgtagctctaatcctcatccctcacctttggacttggctctggtgccctgtaggctgatgaaagtggagaggagacccctgtgtaagtcatgttgagctggtgttgacatggtgcttgggatcctgaaaataggaattttgtcctgccgctcattcatatatcccaagagcactgtctcagattagaaatagagcctgagacaaatttcaggcacaccaaatgtattgagggatgctctggaaagaagctctaagggagtgagagaagcaggcgagacaggggaaggagcctagcagggatgtgttcccaggtaaattctagccttgacttgatccatggggacgctggagtgcaaatgcaaattgtactatggagttgtcccaccttgaggcagggggaccaggcttttgtgcccctatatccatcagtcattggctgcataccaagcttttctacgtaagacagctcattcaagagcagttgtccaaagaaggtcacaggtagaagcttttagtcgtagcacagtgtgtattggctagtgaggagattttggcaggacatcaacggcctacagtgacctaagcatagaggaacaggccaggaccagaacattttattacttcctggcaatatgttctcaagcctcagtgtggaatcatagtgagcagggctggaccctgtgggaacacaaggctccctggcatagaggcttcaggcctagaatctaaacaggtcaggcattctccttggctcttttttcctaggtaaacattaaatctcagacttctgtatcacactttttggatgccaaagaaaagtgaaaataaggaaaagcaaagagaatccccaaagggagatactaaaccctaacagcatggcccactatgaagcaaatccttgttcttcattcattccactaaggaatatttagttgagtgcctatgctgggctgggcactgtgtgaggctgtgaagacaaattccaaggagcagttccaaggccattttgagcaatggcaacatgactaaaataagtgctgctgtggggtcttaggtatccacaagaagggacaggccaaaaaaggtggggcttggggaagccgtaggtcagtggagagtagtggaaagtatagcaacagggcacagccagcctgccagggactctaagggaaaagctgaggtcagaatctggggcactggccaagtctgagaaagcaagttaaggtcagcattcagagcctaggccaggacgaagggctcaggcagaggcatgggcagtgccaggtgctggctgaaggaagatgataacgtatttggcacctactatttgccaggcactttgaatacatttaatcctcacaataaccttgcaagataagtatgagtttcagaaagaagaaaacagtgcttctcaaactttaatgaacatatgaatcagccgtggatcatgttaaaatgcagattctgatgcaacaggtctagggtggggcccaagattgtacatttctgacaggctcccaggtgatactgatactgctggtccacaaatcgtacttggagtagtaagaggttaaaaccctgaccatgacatcaatgcttttattaggaaggaaaagggagagaatgaagggcaagaagacaaaagtagtctagtttgagagactagtcttccaaacaaagtcattgcaataggccctggactgtgactgtctgcactcatgaatgaaggcaggtgtgggcagttgtgggcagggaggtatgctgctctgaagggtggagtggccccctctggatgcttggaaagtaggagtggggacctctggaaagagttcttctggggtgactatacctatttcagtgcatctgatccattgtattttatagtcgtcgttcatacttggcttaatgatcagttaatttggataatatattgtggtggaaataacattccagcaactacttagcctcagaatgaaaccaataccctttctcagtagttctcttgaccttttttttttttaaatggtctgttctttaagaccttctcatgaccttattattaaattttctcctctatcttgttatggatattggtgctaaggcttattgaaacattgctttggggccctggctagtttttaaattaagacaattatgattgtatattttttaaaaagacattgcattgataagatgctttattgtttctagaatactttcattgacattttcttccttttgattttcatgcaacccaggacgtcagtgttattattccagtttacagagaaggaaatggaggcatagaaagttaagtaaattgcccagggtcatgtggctatgtaagtagtggagataacatctttaaagtatttgctggcatcatacactgtgctaagagctttatatgtaacaggacatttacttcttgccccaatttcattattatccccattttatagatgagaacactgaggcctagaggaattacctacttattcaaagtcacagggctagccaggcatggagccatggtctgaaccaaggcactctagttctagcactgatacttctaactactacactagaaagggcaggcagcaatgtttggggccatagcaaaagcaaaaacacttgtgagaatttttccagtcctgttccagaataatggtgccctcactggccacagcaaggacattaagaggcttggacttttcattctcatataaaaggagggttttgttattcttatacgggaggaagaggctactaaaataggtggatgatacataagacctcctaaaatcatctgttgggctcagccagcaccacaattggaaaatatctggcacttatattttggtgcagagccagctcccaaataatcccaccccagttttccttgtactaggtcttctgacacacccttgcccagcctcttcaagtacacgtgcatcatttgggtgcctacaatcgcagcatgaaaccaagttcaccccagatggtacaaatgaaaactccttaatgaaggaactgcttatatagaaatataatccaagttaaaggaacaagcgggatttgaggcatccaaagatcagcagcttggaaagtgcaaagggaagggagagtgtcactagagcttttgtgagctagagccatggaggaactgtagcttgacttcctgggctcaagtaaccccaggaaggacacagacaaggccagagatgtggtgcaaagagggagagagagggaagaaataccccgaattctctctcttcctaccttccatttgcctgccaggacctctcattcctgtgtccaatcagaagccaaactgattagcaagcctgggtgatgcagtctactgaggtcagccccctgaacacagaaaagggcagagacatgtagcgagggcacggaagaggacagggggcacgcagagagtacagcacaggatcttggttctttccttccattccagcggtactaggcacacccttctctccagcccactgtaattccctttgcggggccacaattcctgatccagtgtaacttgcctaatttctttccttggctctgggttttctgacctaaagttctttttctaatgagtcttccttgctgtaaggaaaatggaagactggccaacaggagggtcctggtttgcttgcacgtcaactttctggatgtgtaagccagttttcaagacttgcattgctccagtaggaagctgagtgtgagccatgcctgagtgatggaggaccagaagttacagactgagagaggcagtggtgaagcagatgttgtaccagcatgcctgtggtgccagtggcatcatggccccctggaaaaaaatataggcatatggtggaaacccaaataacaggaaatataatgaatcagattggtaaatctatctggtatatctatctgcaccttgcatttcagtttcaccaagaatcagtcagctgtggtcaaacttgatatctttaaattggtgaagatttattgaccacctgatctagctctctcagggagaatctctaatgatttaatgtcccaccaaattcacatctaaagcttttccaaaagagaattcaattgacttggtgtttgactaaatatttgagaagatgttttaaaaaactggtttaagaaaatttcttaaaatattattttctccattggaaaaattaggaaataatattcctgaatgacaagattattctgaaaaacaaacccaaagtgtctggcacatggtgctcaataaatatcagctatcattattgttacctatgattttacctttgaaaattttgacagggttatataaaaatatacatttagtatttcggttgctttgaggaattgggttctagttttggataattaaactgtaagtctgtaaataaaaatggggtttatttactttttttttctttttttcttattattatactttaagttttagggtacatgtgcacaacttgcaggtttgttacatatgtatacatgtgccatattggtgtgctgcacccattaactcgtcatttagcattaggtatatctcctaatgctatccctccccccaccccccaatagtccccggtgtgtgatgttccccttcctgtgtccatgtgttcttattgttcaattcccaactatgagtgagaacatgcagtgtttcgttttttgtcattgcgatagtttgctgagaatgatggtttccagcttcatccatgtcctacaaaggacatgaactcatccttttttatggctgcatagtattccatggtgtatatatgccacattttcttaatccagtctaccattgttggacatttgggttggttccaagtctttgctactgtgaatagtgctgcaataaacatacgtgtgcatgtgtctttatagcagcatgatgtataatcctctgggtatatacccagtaatgggattgctgggtcaaacggtatttctagttctagatccctgaggaatccccacaccgacttccacaatggttgaactagtttacagtcccaccaacagtgtaaaagtgttcctatttctccacatcctctccagcacctattgtttcctgactttttaatgatcgccattctaactggtgtgagatggtatctcattgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggatatcagccctttgtcagatgagtaggttgcaaaaattttctcccattctgtagattgcctgttcactctgatggtggtttcttttgctgtgcagaagctctttagattaattagatcccatttgtcaattttggcttttgttgccattgctttcggtgttttagacatgaagtccttgcccatgcctatgtcctgaatggtaatgcctaggttttcttctagggattttatggttttaggtctaacatgtaagtctttaatccatcttgaattaatttttgtataaggtgtaaagaagggatccagtttcaggtttctacatatggctagccagttttcccagcaccatttattaaatagggaatcctttccccattgcttgtttttgtcaggtttgtcaaagatcacatcgttgtagatatgcggcattatttctgagggctctgttctgttccattggtctatatctctgttttggtaccagaaccatgctgttttggttactgtagccttgtagtatagtttgaagtcaggtagtgtgatgcctccagctttgttcttttggcttaggattgacttggcaacgtgggctcttttttggttccatatgaactttaaagtagttttttccaattctgtgaagaaagtcattggtagcttgatggggatggcattgaatctataaattaccttgggcagtatggccattttcacgatattgattattcctacccatgaacatggaatgttcttccatttgtttgtatcctcttctattacactgagcagtggttgtagttctccttgaagaggtccttcacatcccttataagttggattcctaggtatttcattctctttgaagcaattgtgaatgggagttcactcatgatttggctctctgtctgttattggtgtataagaatgcttgtgatttttgcacatcaattttgtatcctgagactttgctgaagttgcttatcagcttaaggagattttgggctgagacgatgggattttctagatatacaatcatgtcatctgcaaacagggacaatttaacttcctcttttcctaattgaatgccctttatttccttctcctgcctgattgccctggccggaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttatggagagtttttagcatgaagggttgttgaattttgtcaaaggccttttctgcatctattgagataatcatgtggtttttgtctttggttctgtttatatgctggattatgtttgttgattttcgtatgttgaaccagccttgcatcccagggatgaagcccacttgatcatggtggataagctttttgatgtgttgctggatttggtttgccagtattttattgaggatttttgcaccaatgttcatcaaggatattggtctaaaattctcttttttgttgtgtctctgccaggctttggtatcaggatgatgctggcctcataaaatgagttagggaggattccctctttttctattgattggaataatttcagaaggaatggtaccagctcctccttgtacctctggtagaatttggctgtgaatccatctggtcctggacttttttcggttggtaagctattaattattgtctcaatttcagagcctgttattggtctattcagagcttcaacttcttcctggatttagtcttgagagagtgtacgtgttgaggaatttatccatttcttctaggttttctagtttatttgcgtagaggtgtttatagtattctctgaaggtagtttgtatttctgtgggattggtggcgatatcccctttgtcatttttattgcgtctatttgattcttctctcttttcttcattattagtcttgctagaggtctatcaattttgttgatcttttcagaaaaccagctcctggattcattgattttttgaagggttttttgtgtctctatttccttcagttctgctctgattttagttatttcttgccttctgctagcttttgaatgtgtttcctcttgcttctctagttcttttaattgtgatgttagggtgtcaattttaggtctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcactcaggagcaggttgttgagtttccatgtagttgagcggttttgagtgagtttcttaatcttgaattccagtttgattgcactgtggtctgagagacagtttgttataatttctgttcttttacatttgctgaggagtgctttacttccaactatgtggtcaattttggaataggtgtggtgtggtgctgaaaagaatgtatagtgtgttgatttggggtggagagttctgtagatgtcaattaggtccgcttggtgtagagctgagttcaattcctggatatccttgttaacttcctgtctcgtggatctgtctaatgttgacagtggggtgttaaagtctcccattattattgtgtggaggtctaagtcactttgtaggtcactgaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatcagagactaggattgcaacccttgcctttttttgttttcagtttgcctggtagatcttcctacatccctttattttgagcctatgtgtgtctctgcacgtgagatgggtttcttgaatacagcacaatgatgggtcttgagtctttatccaatttgccagcctgtgccttttaattggagcatttagcccatttacatttaaggttagtattgttatgtttgaatttgatcctgtcattatgatgttagctggttattttgcttgttagttgatgcagtttcttcctagccttgatggtctttacaatttggcatgtttttgcagtggctggtactggttgttcctttccatgtttagtgcttccttcaggagctcttttagggcaggcctggtggtgacaaaaatctctcagcatttgcttgtctgtaaaggattttatttctgcctcacttatgaagcttagtttggctggatatgaaattctgggttgaaaattctttctttaagaatgttgaatattggcccccactctcttctggcttgtagagtttctgccaagagatcagctgttagtctgatgggcttccttttgtggttaacctcacctttctctctggctgtccttaacattttttccttcatttcaactttggtgaatctgacaattatgtgtcttggagtttctcttctcaaggagtatctttgtggcattctctgtatttcctgaatttgaatgttggcctgccttgctagattggggaagttcacctggataatatcctgcagagtgttttccaacttggttccattctccccgtcactttcaggtacaccagttagatgtagatatggtcttttcacatagtcccatatttcttggaggctttgttcatttctttttattcttttttctctaaacttctcttcacgcttcatttcattcatttcatcttccatcactgataccctttcttccagttgatcgcatcggttactgaggcttgtgtattcatcacgtagttcttgtgccgtggttttcagctccatcaggtcctttaaggacttctctgcattgggtattctagttatccattcgtctaattttttttcaaactttttaacttctttgcctttggttcaaacttcctcctttagcttggagtagtttgatcttctgaagccttcctctctcaattcgtcaaagtcattctctgtccagctttgttccattgctggtgaggatctgcgttcctttggaggagtcgaggccctctgatttttagagtttccagtttttctgctctgttttttccccatctttgtggttttatctacctttggtctttgatgatggtgacgtacagatgggtttttggtgtggatgtcctttctgtttgttagttttccttctaacagtcaggaccctcagctgcaggtctgttgaagtttactggtggtccactccagaccctgtttgcctgggtatcagcagcggtggctgcagaacagcggatattggtgaaccacaagtgccactgcctgatcgttcctctggaagttttgtctcagaggagtacccggccgtgtgaggtgtccgtccgcccatactggggggtgcctcccagttagactactcgggggtcagggacccacttgaggaggcagtctgcccgttctcagatctcaagctgcgtgctgggagaaccactactctcttcagagctgtcagagagggacatttaagtctgcagaggttattgctgtcttttgtctgtgccctgcccccagcagtggagcctacagaggcaggcaggtctccttgagctgtggtgggctccacccagtttgagcttcctggccgctttgtttacctactcaggcctgagaaatggtgggtgcccctcccccagccttgctgctcccttgcagtttgatctcagacctctgtcttagcaatgagtgaagctccatgggcgtaggaccctcctagccaggtgagggatataatcacctgttgtgccgtttgataagcctgttggaaaagcgcagtattagggtaggagtgacctgattttccaggtgctgtctgccacccctttgactaggaaagggaattccctgaccccctgtgctccctgggtgaggcaatgcctcaccctgctttggcttacgcacagtgtgctgcacccactgtgctgcaccccctatctggcactccccagtgagatgaacccagtacctcagttggaaatgcagaaatcacccgtcttctgagttgctcacgctgggagctgtagactggagctgttcctatttggctgtcttggctccacccccttttacttttttatttagttttgatacagaatcttgctctgtcccccaggctggagagcagtggcatgaccttggctcactgcaacctccgcctcctgaattcaagtgattctcgtgcctcatcctcctgagtagcttagattacaggcatgtgccaccaagtgcagctaatttttttatttttagtagagatggggttttgctatgttgcccaggctggtctggaactcctggttcaagtgatctgcctgccacagcttcccaaagtgctgggattacaggcatgagccacctcacctggcctggggtttatgtgtataaatcaatattacagatggaggtatgcagtattactatgaaatcattttatcaaaacattaagtcttaattttatcaagtcactagctccaactaccaagataaacaaaatatagaggagataagaacatgttaaacaacaccatggggatgcaatcaacaaatccagactgtagattttatgaactgaattacatccctcaaaattcatatattaaagccctaacctgaaatgtgactgtgtttggtgataggggttttgtattggtctgttttcacactgcgattttataaagaactaccaagactgggtaatttatgaagaaagaggtttgattgactcacagttctgtagacttaacaggaagcatgactgggaagccccaggaaacttacgatcatggtggaaggcaaaggggaagcaggcacgtcttaccatagtggagcaggagagagagagtgagagtgagagcgtgaagggggatgtgccacacaccttcaaacaaccagatttcatgagaactcactcactatcaggagaacagcaagggtgaggtccgtccccatgattcaattacttcccactgggcccctgccccaacatgtggggattacaattcgagatgagatttggatggagacacagagccaaaccatatcatcttttaagaaggtaattaaggttaaatggcatcataaggatggagacctaaatccaataggactattgtctttgtaagaagagggagagatatcagagcttgcaccagccacctcccccttgcctcaccaatcccccttctaccatgcacccacaaagagaaggccatgtgagagcacagtaaggaggggctgtctataagtcaggaagagaggcctcacgagaaagcaaccctgctggcaccttgatcttggactttcagcctccagagctgtgggaaaatacatttctgcagtttagactacccattaggtggtatggtgggccctccatatccatgggttctgtttctgtggattcaaccaacaaaagattgaaaaatatttgaaaaagaaaattgcatctgagggtcaagcatggtggctgatgcctgtaatcccagcacgttgggaggccaaggtgggagggttgcttcaggccaggagttcgagaccagcctgggtgacagtgagaccccagtctctgtaaaaaagaattttttaggctgggcgtggcggctcacacctgtaatcccagcactttgggaggctgtggcaggtggatcacctgaggtcaggagttcgagaccagtctggccaacatgataaaaccccgtctctactaaaaacacaaaaattagctgggtgcagtagtgcatgcctataatcccagctactggggaggctgaggcaggagaatcacttgaacctgagaggcggaggttgcattgagccaagatcgtgccactgtactccagcctgggtgacagagcaaaactccatctcaaaaaaaaaaaaaaaaaatttttttttaattagctgggggtggtggcacacacctgtaatcccagttaggaggctgaggacagaggattgcttgagcccaggggatgaaggctacagtgagctatgattgtgccacagcactccagcctgggtgacagagcgagaccctgactctaaaaagaaaaaaaaattgcatctgtactgggcttgcacagattttttttcttgtcatatggtaaaaaatacagtataacaactatttataatatttaaattgtattatgtactatagagatgactagactagattactccaagtaatctagagatgatttaaagtgtacaggtggatgtgtgtagcttataggaaaatactacattattttatataagggacttgagcatctgcagatttttgtattcaagagaggtcctggaaccaatcccttgtgaataaggagagactcctgtgttttgttatggctgcccaagcaaactaatacagtaggaaactttacaggactatctagcttctttaacaagtaagttgcacctagcgcggtggctcacgcctgtaatcccagcactttgggaggccgaggcgggcggatcacgaggtcaggagatcgagacaatcctggctaccacagtgaaaccccatctctactaaaaatacaaaaaaattagccgggcttggtggcgggctcctgtagtcccagctacagctacgctggaggctgaggcaggagaatggcgtgaacccgggaggcggagcttgcagtaagcggagatggtgccactgcactctagcctgggcgacagagcaagactccgtctcaaaaaaacaaacaaacaaacaaaaacaaaaaaccaagtaagttgcaacaagaaagtgcgtgtgtgtgtgtgtgtgtgtgtgtgtgtgtgtgtgggagagagagcgagagagagagctagattaagggggaccttacagattaaagacacttaaaagttacaaccaccagtagcaatgtgtgggccttatttgggtactgatgcaaacaaactggaaggaagaaaaagagagaaagatggaaagagataactacactatgacatttgtgagacaattgtaaatttgagcactggatatgttataatattaagaaggaattttttatttcttttaagcataatcaagtttattcaggtacacactgaaagttttacagataatatgatgtctggaactggctttaaaaatatagggggatgtggaaatttaaaaagttgatctcatagaatagagagtagaatagtggttactagaggtggggaagagtagagaagagaagagatagggagatgttgtctaaaagatacagctagatagaagtaagttctagtgttctatagcattgtagggtgattatagttaacaattttttgtgtattttcaaatagctagaagagaggattttgaatattcccaacacaaataaatgtttgaggtgatagatttgctaatcaccctgatttgcccattacagattccacccatgtattgaaatatcacactgtacctcataaatatgtataattattgtgtgtcagttaaaaacaataaaatgtttaaaaatatcatgtagcaggtgataaaataaatgaaacaagattggctgtgaattgatagttgttaaagctggtaatgggttcatgtgggttcattatacattttctctactttggtacatgtttaaattatccataataaaaagtttaaaaatgattttatgagaactagaaaattattttctctcaaactcagaaatatctagaaataccacttatttatgatttattgacaataaaaggattttacaagcaagggagaccttgctaggaaggtttgctggatatataaaagcttccatgaaagcacatccaagaagagttcttgacattagcattcaataaatgtttattaagcatctaccacagtgaggtatattcctggtgctaccaacaagatggacacagtccttgacctctcagggcctaaagtctagcagagctgattgactaaaagcaagtaagctgatagatttttaaaatatttttgagttatcataagtgttataccactgacaaggactgagataggctcgtttagatgggggctgaaaagaaaaacctttccacaggagtgtcatttaagcggagagacacctacaagatgagataaaagagccagtcctgggggcagtgtagagagaatattcaagtgaggaaactggacaaactgattgggagtttggtttgtcagaggaactgaagaaagccagtacggctgaggtgtgatgacctgaggaaacatgaagtaaaatatctgagatgaggtgagagacctaggtaggggctaaatcatgcatcaccttttaggccacagtgaggagcctggattttatcctaggacctatgaaatccattggggattctaagaaaggagcttgatttgccacaggagtagaatggaagtttgaggaaggttggcctgaaagagagagcttgaaggagcaggggaagagggcattaaggccctggagctccctcgaggactcatgagatagcagtgggatcttccaaggtcaccctgtgtcagcagcctcaagagatggggtctccctgacttgcccagtgccccggcagctggttaagtaggaggatattcttgtaatttgttgttgtgtaacagaccatcccaaaatttagtggcttaatgccatagacatttctcaggaatctgcaatttggacctgaagggatgatttgtccctgctccatgccacatctggggcctcagctgggatgatggaaatggctgaggctggcacagccaagggctagttgggcctctcactctctcttcgtgtagtctcagggccactctgtgaggtttcttgtgtagtctttccagggcgatagcctcaggtgagttggacgtctcatgtcacaattcagagctgcaaaagcaggtgctcccacagaacacagtggatgtttcaaggacatttggatctaactctagagttacacagtctacttctacctgattctatttgtcacatggggccagctctaattctttatggaaagggaccacctcagggcatgatcattgacagcagcttggaagctggctaacaagagtttctacatttgtatacactgaatgtggggctcccaaagggacatactcagagaaacaaagatgatcgtggttatattacccctgtgggagagatctgatttaccctggcggcgaatccgtatgggtctgcagcaacttcaattcttgcctactcagaagaaagaattcgactgaggggcataagatggaaaaagagactgagacaagttccagagcaaaagtggaagtttatttaaaaggccttagaacaagaaagaaaggaaagttcacttggaagagatctaagagggcatgtaaaggttaaagagagagagaaggtcaactgccccctttaaccacggtcctaggacttttataggcttgcctctttcccatgattcttccctcatggtgggctgctcacatgtgcagagccctccttacccttgggaagtgagcatgtgcagtgagtttagaaggctgaacatgtgcccgtctgaggctttcttcctttttcctgtggagtgttcccagacaatcatactttgccattttcgcctgttaatgtgcatgcgcaggaagatgcttctcccgggggtctgcctttaattaagcctttcatgttaacaggtgtgaaccatcaagaaatggcccctccctggcactggctgccaatttatcacttttagagaggcaatgtgataatggccgaaccatcacctgacatttctagtagatcaggggagagagcccgctcctgcctggctcatgcctacctgtaacagttgggccaactcttagccttccattttgcagagtggattgccgcaatttgaaaagagctgaagtaccagggacagcagacaggatttcagaggctattagggaagacatgataagagctgagagggctgaccgaagaggattctgaagggaaccaagataactaatgaggaatctgagaagtctttgctttgtggtgtatgaagtcaatcccctttcccttcccttcacgaaaatcttcagtaaattgctattttgttaacacattgtggatctgttttgagggatccatcaaatgctgagttctgttttcaggaaggtttgggatgagaacagatactgcccaagggagccacacttggcatactagcgaacaaaggaaaaactaaataatgaatggatggataaatggatcctagaattcctataaccttccactggctaatcataacccctggcaaacctggaattacttctatctagcctccagacaaattctggaactggccatttctgatctctttctatcccaacttcccttttgcttgttttttcccactatcacattgtgaatttgggagttgaaatagtttctgtagtatcaactctctgtttacttactctttaactctttgacgtgtattgagtgctgtgtcagatgcagtgctatgtgcagtgaagaattctgcgaaaaagtggaactcatagccagaggtaaagctggaagaagcagtgccacagacaaggcaagaatcaaatgctataactgttcagagttggggtgtcactgaggacagtggagggtagaaggttgtgaaaagcttcacagaaatggtgggcatctaagccaaaccttaaataaagagtgacatttacacatgaagagataaagattgggggttttgagatggagtaaggaagtaatccctggccaacccactcagtcttccccatcaaggtgctgctgacttgtatctatgccctcttggatctttccttagtgctttcctggccgcaaaggcagctagctgcattggtattttaataaaaatggctgcaggcttctccatccacatatccctcaaggttccttatcaactataatctgggaacagctctcctgctgaaacagtgagtagaatgaatggcactagtagaggcctgggatatgaggagggaaactgaggtccagagaaagaacaccgatgctgtgtttacttatctgttctcaacaaataaatatattcatgtgtgtgtatgtttgtttccccacctagactatgagctcctcaagggcatgaactgagtctcacccatctcagtacactcagcatagagtgtggtatattgtaagtgttcatatttggtagctgaaatagcattctagagcttaaggcagtgattctggaagtatgatccttggacctatggcatgagctgggaacttggtggaaatgcaaattcatggggcctcatcccagacctactgaattagaaattatggagacagagtccagcagcctgtgttttaacaagccctccaggagattctgatgcaggttaaagtttgagaatcattgctttaggatatttgagcctagactaagacttgctctggcctcctttgggacttcaagaactaagcttctttttatcttataacagacacatccttattttattcttttatcccctgccccttaacaaaagaaaagtgacagaaggagaaaagaaaaaaaatatcataaaggtattgccagtgaccagggaaaataagtaagtaatggcaagtttctttccttcctgaaaaaaacagaaactttgcctgtaaaaaatatattcaattatttttaaaagactttttatagaataggaagagagcaaataaaaatgtatatatatattaaaaaagcactttggttttatgtgaaagtgttactcctcccagacaaaaccacatgctcattttccttgtcaatctccattgtcatcactgataattcccagaagccgccaccagaatgtttctttctggagtggagaatcttgtaaaattcattattttcttgggcactcacaatgctcccagacctatgggacagtcagaattgatgggatcctctgccctgtgcatgcttgtacctggcagataaggacaacaaagaatatttgtgtatatccatacaggatcaatccccatgtaacctggatcctcactatgtggtcaatactgaggctggctttataccagcatacatatatagttgtgattttattcatatcctcaaggaacccaaaatctattgggatggtgtgataaatacatacaaaattgacttcattgtaagatcagggcttttcgagtttacacagtgttttcacatacagtttcatttgatccttagagcagttcctgggagcagtacatgatggctgcagcaaagtgagtcccaaacttggatctatagaatgagcttgttataatctaaaaggaactcttcctgacttatgattgttcattgggtggctaaagaggtgagtgtagtctcaggaaggcaagagaggattgtgactatatctaagagagcttaatccaatcagttacacaagacatgatttgaagggggaaaaaaagaatgtttatgcaatgtgtccttttaactgacccccacttggggaattattacaatagtgtttaatttataggagacaatatttactgcctcttccaatgcttctagtgaaagcatacgtcaaagagggtggaagggatctaacagtgttagtatatctgccaattttcgagtgttggcaacagactcaaaaagttttaatacaccacattgtccaaatgaaaccaccaatttgcaacccatactctagaattgataatgaagaagaagacattctgaaagaagactagccagtttagcagatgtgctgttttctctgtaaaatatactgatgaatatccacatccctaaaatcttctgatagtccagtctcttctatgctcagcacttctgctctgaccaattatgttatgtgctttcttcctagagtcagttgagttcgttcccaaacctgcttatgccagttgtactattttataattatacagctaaataaaatactaggccaaccaattaaataataggtgcaaaaaatgagttcttccttttatgaaaattaagttggatgctatgaaaagacttgacaaaagtgttttgattaaaatgaagttgcagcctgggtgccttggctcatgcttataatcctagcactttgagaggctgaggcaggaggatcacttgagctcaggagtttgagaccagcctgggcaacatggcgaaactccatctctataaaaaaaatatgaaaattagctgggcgtggtggcttgcgcctgtggtcccagctacttgggaggctgaggtgggaggactgcttgagcccaggaggtggaggttgcagtgagccgagattgtggtactgcactccagcctgggtgacagagcgagaccctgcctcaaaaagtaaatatatatataaaatgaagttgctattgaataatatgtaagtgagacaatggtgattgtggcaagaattgtaaaaatctggaggaattctgctctgaagttgtttcacaaaggtctttatattcttgatccactttaaagaatttcaataactggaaattttagatgataccttattggtgggctttatgtaagagaaatgaggtcaattttaaagaaaaggccttagccctatatttaaaaattgtcaattaaggccaggcgcggtggcttacgcctataatcccagcactttgggaggccaaggagggagatcacctgaggtcagaagttcgagaccagcctgaccaacatggagaaaacctgtctctactaaaaatacaaaattaaccacgtatggtggcgcatgcctgtaatcccagctactcgggaggctgagacaggggaattgcttgaacccgagaggtggaggttgcggtgagctgagatcacaccattgcattccagcctgggcaacaagagcaaaactctgtctcaaaaaaaaaaaaggcaattaaggtacagttaaatgctgcagactaaaatattaaacatattcttttttacgatttcctcattttttccaattaactttttttgaatttagttttaaaagttctgttgacggctgggtgcagtggctcactcctgtaatcccagcactttgggaggccgagaggggcagatcacgaggtcaggtgttccagaccagcctgaccaacatggtgaaactccgtctttactaaaaatacaaaaattagccaggtgtggtggcatgcatctgtaagcccagctactcaaaaggctgaggcaggaaaattgcttgaacctgggaggcggaggttgcagtgagctgagatcacgccaccgcactccagcctgagtgacagagtgagactctgtctcaaaaaaaaaaaaaaaattcttctgacaaactacatttctccactttgctaaacaagaggacttgtactgaactacgtctgcatggatcttagataaataagagacaaggcttcaagagaataaaaagttggtggtgttctccagtgctgacttgaataactgtcccttggagctctctctagtggagggtgtggttgtttgagttcaatgacgtcatgccattgatgtcattgaccacaatgctttgtgtgaaccctgaaatacagaggtactaacatcaggtagcacagtaggcagctgcaccaaggggagttaagcatgccttctatgatacttcaacagctaacagcaatgaaaattattgattattggtgtttatcatgtatgagtttaattaattgaatgcatttaaaatgcatttagtttttacagcaaacttataaagaaattgaggcttgaagatgtgaggcaatttacccaaggtcatataactagtaagttggagagaccagaattcaaattcagatttagcctggctccaaagtccttgccattgaccaccttgagcatgtatctctcagttatagtaaccacctgttgagtgtagtagccacttgtcttgtatttggcacaacactaaatgcttcatatacttaaacacactaacacgtgattatatttcattaagtgcgtatagggtgttctagaacactttgaatatctcttggttacagctgattctttattcgttggttagaatagcatgatggagatgcaaggatttgatcttagccaatgtattttgtaagttaccaaattttagagagacaatgtgatatagggcaaaaatgtggtctttgtagtaagactgctctgtttgcatcttggctttgccactttctggtgaagtagcctttataaatcatgttacttctctgggcctcagagctctcatctgtaataatgagtatgatggtatttactttgcagagttcttgtggaaacaaaagatgatacttctaaggtctagtgaagcttttggatcattataggaactcaataaatgaaaatttcagccaggcacagtggctcacacctgtaatcccaacactttgggaggccagggtgggtggatcatttaaggtcaggagttcaagaccagcctggccaacatggcaaaaccccatctctactaaagatacaaaaattagctgggagtggtggtatgtgcctgtaattccacctactggggaggttgaggcacaacaatcgcttgaacctgagaggcagagattgcagtgagcctaggtcatgcctctgcactcaagcctgagtgatggagtgagactctgtcttaaataaataaataaatgaacattttaaatgtgtgatacattgcatggctcattgggggcatttgagaaatggtaaccattatggttaacacctgtgttgtaattgtttgttgactttttccctcacttgattgattgattcattcattcaacaaatatttattcaccacccactgtatgcaggcacagaggttaagtgggacataaaatagtgtaattagctaaacatgtttttgtcctcgagtttaccttccattgaggaagacagaaaataaaaaatgtattaatatataaaacgttgacagtgttgtaaggaaacccaggatgtgctgacttgggaaagtgggttgggtaagtggacccaactgaaataagtggttggaaaagcctcccctgaggaggtaacatttaagctgatatccaaaggatgggaagcgtgggataagcttcccaggaagaaggcagcctggagtcctgaggactggagaagtggtctgtgtggagggaggaggagcataatagagcagaaaggaaagttggagacagacagggactagatcttgtggggctttgcaggccatggtaagaggataggattttactctgaaactctgctctatagagttgtgagtgaggaatgatggttccttggactagagtgagcagcagaggtggagaagtggataactctcaggcacattttaagattgtgcacaactcaagggcaggaactgactccgatttaatttggggtcacaatgagtagtgaggtgcttacattgtggccattcaataagtgttcttgaaattagatagtagaaattagttattctatgataagaccaattatctgtgctatcatataagcttccagtataatataaacttaagtgtgtgggcttggagtttggcagactcccacttactggttgtgtaactctatgttttattttcttcatctgtaaattaaagatatttgttgacaaagatgaattgacatgatgcacctaaaatgctttaaaatgtgtctggtacatgtaaaacattcttcaccttaattgaaattcaggcaggtctccctttcagtacacactaacttgtagcacttgggagtacaatttgctcattttcccttttcatatttgccatggagtctaggagcattttgtaaaaatcagtctcctgtcaattctaagtcattgctcctcctccctcataaaaataagcaagataaacaagtgagagaatacttctcctttcaagcaaataccatgtgaacatagaaacctctactcttcctggccatttcatattcttcctgataatgcacacacatattttatgacctaactcctcttttcttttaattagttttgctgaataaagcaggcaatttatgctacatggctggctccttcctgaagatgctcaaataatttattttgaggaatctggcctctgtaatgttaaagcaagtaaattatgaacactataaggtgtcatgataatgataattacagtttattgaggctactctgtgccgggcactttactaagcactttatatatcctgtttgattactttacttcaattgtatgaggtatataaagagttatcagatatccctaaaaactctaagccaacataggaataaaggtatgacttccatacattgattgaagcacacctggaaagaaactgtaggaaagagggatgaaaaaaaaattaaaccagtggagcagaatagattcccagaagcagccccatacatgaaatgggaactttatatgcaatagatctggcattgtagattggtggaaaaagagggcccattaaataattgatgttaagaaaatcagatgtccatatgaaaaaattggtcctatcttacaccttaccaataatcaattctaggtaaatcaaataacctgagtgtgaaaaacaaaacttcagaattttagaagaaaatataagagaatatgtgtctgacgtcagtgtaggaaatagtttcctaaacaaagaacaaaaagtgcaaaacatgaaggaaagtattgtcaaatttagctctattaaaatcaagaacttgtgtttattgaaagctggcagaaagaatgtgaaagtcaggctatgatctgggagaagaaatatgcaaaacatataacaaaggaattttacccagaaaaaaattatattttattatatatatatatattttttttcttttttttgagataaagtcttactctgtcacccaggctggagtgcagtggcgagatcttggctcactgcatcctccacctcctgggttcaagcgattctcctgtctcagcctcccaagtagctgggattacaggcacacaccaccttgcccagctaattttttgtgtatttttagtagagactgggtttcactatgttggccaggctggtctcgaactcctgacctcaggtgctccacccacctctgcctcccaaagtgttggaattacaggcgtgagccaccacacctggcttatatatagttttttatacatgatacatagatacattttataacacgtgcatgtatcatatacaacaaatatattaaaagtcaataagaaaaagtcagtagaaaaaatacacaaagggcattgcacagaagagaaccaaggatgtccaataaacaataggcaaacatgctgaagctcatttataattaggacaatgcatgttaaaccaggatgacagactactttatatccctaaaattgataatttttttttcctttcttgagatggagtctcactctgtcacccaggctggagtgcagtggtgcaatctcagctcactgcaacctccatctcctgggttcaagcgattctcctgtttcagcctcctgagtagctgagattacaggtgtgtgccaccacacccagctaatttttgtgtttttagtagagacgggttttcaccatgttggccagcctggtctcgaatccctgacttcaggtgatccattggccttgacctcccaaagtgctgggattacaatcgtgagccacacaccaagctgataagatattaaaaaaaaaaatgttggtgaagctgtggaataacagaaactcttatacactgttggtgggagtataaattatttcaaccacttttgaaagtaatttggtattgtgtaatcaagttgagtataggcataatatgttccatgagccagcaattcctagggatgtgtgtgtacatgcacaaatgcatgcatgcacacacacagaccccttagaccaactcttgcccatgtgtaacatgagccatgggcaaaaatggtcataataactttttttttgtagtaacaaaacaataagaaacaatttagaagcctattgataggagaatggataatttttgctatacttattcaatgaataccttgcttcactgaaagtgaatgaacttcagctatgtgtatcaatatgaatgagtctttcaaacaaaatgccgggtgaaaaaatccttacagaaaatatatacaatgtaacatttatataaagtgtaaaaacaggtaaaatggaaccatttattgtttaagatgtgtggcaaaagtaatgggatgataaaacaaaattacttttgggagaagagaaggcaggagaatggcacagaggaggggcatagaggggatttcaaaagaactgatatcattatcgttcttgcttatatctggggggttcatattgttattgttaatactttatacattttatacactgttgtaagtatgaaatgaggaagaaaaatggagataagagatgagaagatgactggaatgaatggctatataggtaataacccaaagaagcaatatcttttgaagataccagccaaatattcacttttatcttctctataaccctttctcattccttctgctttcctctaccaaaaacaaaaacaaaaaaggaaatcaaataaataaataacatataataagggtagaatcaattatttaaaaagcaaataaaattctgatctataaaatcaagataaccaaatagaagatgcccttctgaaggctgagggaaatgttctgctgtgacattgactcttcatagccaggttgtattaggccattcttgtgttactataaataaatacttgggctaggtaatttataaagaaacaaggtttatggctgggtgcagtgactcatgcctgtaatcccagcactttgggaggctgaggcgggtggatcacttgaggccaggagtttgagactagcctggccaacatggtgaaaccctgtctctactaaaaatacaaaaattagctgggcatagtggagcatgctgtaatcctagctacttgggatgctgaggcaggagaatcacttgaacctgggaggcagaggttgcagtgagccgagatcacaccactgcattccagcctgggtgacagagtgagactctgtcttccccctacccgccccctcaaaaaaaaagtttaattggctcatggttcgcaggctgtataataagcttggcactggcatctgctcggcttctgggaaggcctcagggagcttttactcatggcagaaggtgaagcgggagcaggcacttcacatggtaaaggcaggagcaagagagagagtggcagggaggggagatgccatactttacaacaaggtctcatgagaactcactcatgatcccaggtcagcactaagccatgagggatctgcccccatgacccagacacctcccaccaggccccaacttcagcactgggattacagtccaacatgagattttggtggggacaaatatccaaactatatcacaggtataccctgtactgtatgatatgaacatcaggcagtgatagtctgctgaaatgtagttatatagagagaaaccttggagtaagagtcttgaagagcttgttgtttaaccctcagagtgtttttgctcagaataactcggaatagctggctacaaagtctggagtctctctgtgcagcatgcagatacctatgcgttcatccatttatccatcctttatctttcctccagcattcattgagtttgccctttatggcagggataaggaggtgctagagatgacaaaaagaaaaggcagagctaattaccctgcaggatgatggtgtgagattggagtcaggtctccagcagagttgggggcatgaggtcacagggggttagctctgcctgctgagaggtaacagagggcttcatcactgaccagatgactctgtgccctgatgtgtcttgaaagacagagaaaaagctttcagacctgaggtcttcaaacgtttatgttttgctcatggacttctaaaggaaatctgaaatagctatgcactgctcacagtttttatgctgacatctaaaaatttttatcataagtttaagtaattgtaaagaaattccctgttacaacaagtattggcatctcaaaacaagcccctcatattttaaaaatgtttccagtggaatctacatactaatttgatatatattcatcctttttttaaaaaatacaacaagctcttcttaatgtattgacattttatatatcgtgtaagaaatgtttctaatggaatctatacaccaaatgatttcatcatctttttagaagtagcagaacaagctcttcttaaattttacatcattctttcttctccttggatttgtatttccatttctttaccttacagaatttatcctatgaaacataccttgtgtcatatttctctgtaacaatgaacaaggatatacagtctataaagctctaagtgttaaaacatctcttctgcattgagtcattatgatgattattggtatacaattggtcaaaacaacataaatatatgttttgaggattatgaaagaaaagttttatgggaagttgatctcttaattagataggtagagttgtttttctttgctctctcgtttttggcaattatatttattgttggctattattgctagaatgagatagtattcagcatcaatattcaccctattttttctttttttaattagatataaatgctgagaaattttgttcatatttaagccgtggaattggaagttttgtttagaaatatcattaaggccgggcactatggctcacgcctgtaatcctaggactttgggaggccaaggcaggtggatcacctgaggtcaggagtttgagaccagcctggccaacatggcaaaaccctgtctctactaaatacaaaaatcagccgggcatggtggcaggtgcctgtaatcccagctacttgggaagctgaggcaggaaaatctcttgaacccagggggtggaggttgcagtgagccatgatggtgttgctgcgctccagcctgggtgaaagggcaagactccgtctcaaaaagaaaagaaatgtcatttaattattgaattatttttgagttaaaaagcaaaaattatttactgatttttctcttaaaattattttttaaacagctgttattatataattcatatctcttgtaactttgttgacagcaatgactcaataccaattgacttgtgaaaagtatttgtaaccagttatgagagttagtaacttcctcaacaataataccagtagacctaaaaggaagaagctaaggcaaaattactatagagagtttatttgggccaagtttgaagactgcaccccaggacatacttccaggttgccttggagagtgctctggggaacataggagaggctcaagtttttaaagataaaaggaacaaatcaagagagtgggtaattcttcaggaattctcattggtttacagaaataacatttgttagtgattggctataccttgttgaactgtaggatgtatggcgctttatggctacttggcattattctagagcctgcatagcaaatggcttcaaaaggtaattatctagctcaaggaggagtgagacatgactactgttacgtcttcaatgcctctctgggcctgataatttaaaggggcccacatgcctcagataaaaagcttttttttctcatatgaatatttcaaattgttcctttgcttgggaacctggaggtgttttcaccctgaggtaacaacgcaccactgtaagatgtgggatggaagagagaagagcctttcttttgtaaagtgggaagaaatccattgtaaaagggcaacttacagcttgacctcactgtctcttagattttaggaaagagtacaaataggctttgaggatctggaaattgatttccttaaaacaactcaagattccacatgtaaagttttccagattgttgctacttttagcgtggtctgtgggccagcaacattggcatacctgggagctgttagaaatgcagaatctcagccccagcctagacctcctaaagctgaatctgcaaaatcccagggcgattcactagcacattaaagtccagattgctgccacttccttcccctcaaaaccttgtagtgcacacattggctgttatgcagtttccttcccagtgtaggagtcatttacatacctcttgagcagcctctgctcataattttggctttggttctccaagaagtcacttggtttagtttccagcagtctgtgaggcctactgggctgggctttctgactctgcaaataatttaaacactgtttatcgtggtccctaaggaaccctcagtaagtggtagctgatagttatcattttcctctcactaatggtcagatttgagtaagagatcctttttcctccttgagtgtcactcgagcctgtgattttgaattactggatgttaagattggcaagacctgtgtgtgtcatggagaggtttcctcctatcatcccagtgaacattgtgaccttgtcattaggagagctataaatagaataattttttttaaggaaaataaaagcctattcaaacagagcatcagaagctgctggttctagcaagaagaaaatggctgattgtattttttgaaatgtctttgcctttccctgtatttttgctgtgttgacagttgtgccatccaggcttgacctagccctcggccctccctcttggctctgcattgactttttgtatatgtgggattccagatctgtaaacaagggggcccggtgccaaagcctccctcttgggtgcaaacacccaagtgtcagtggtgtttggaagcagaggagcagtccgtgggaggaagcattccccgacattattctcactttgcacccccaacaggaaatcctgcagtatcctgggaagaacaaggatgctcagtgttcaaatcctgcctggttttacctaagctccctggacttctgtgtctctatctctaaaatgaccatcaactcaaatggctatgggaaaattaaatgagactaagcatatgtgtagataagtggatgctctaaaaaagtgattttcctcctcctttcaaacaaacggacagtgcttcttaaaatcaatgcttcataaaatcataggctcttgggctggggaatattctttaaaatcatgacatttgctgtggaagaaactagagggaaaaaaatgaacctacactgctgagccaagtttcagattttacaatagtgcctgtgcactaatgataatttaagatgatggtgtccaggaagggacccatttctctacagctgattagccacagatcagtgctatgggttatagaactaggaaggcagaacatgaatagacagagataatatgtagagcagaaggagcacaatactgagagtccttgaatgcactttatttgctgctttgagcagcactttgaatagcaaaattatgcgttaatatcagtggttcacaaaatgtggtccctgatcagcagcatcagcatcacctgggaacttgttagaaatgcaaattatctggcctcgccccagatctgctgaatcagaaaccctgggagtgaggccagcaatcagtgttttaagcaagctttgcatgtgattcagatgaacgctagagtttgggaattactggtttacattttaacagcttacaaccatcttttccaatgcaaagcaaagtggaatcataaatgtcttagcattttagattccttacctcctttacatatactgtgaaaattcccagatattattgtcttctgattcttgcagagatatgcatgagcacagtcactaggtagaacttcctcagttgccttgggtggctgttgtttaattatgaagcagtaatagaaggattctgaaaattaagcaaatgaatctgctgtcacttctgttctttagaaatacctttcctagtttggatgcagtggctcatgcctgtaatcctagcactttaggaggctgaggcaagaggataacttgagaccaaaagtttgagaccagcctgggcaacatagtgagaccccatctctaacaaaaaaccccaaaattacctttcctctagagttacaatacatttataaccttataacaaattgtatacaaatcactatgtttttatttctacaccttcacagtcctgtctctagaagcagttacaccaaagccctgtgttgtctggaggtgtgaagacagacactctgggcccctccaaaggatgtcatcactcaggcccaacttctgcttattttgaatttcctgtttgatggttaaaagtcaaggagaagaccagaagttaaaagcttgtaccacattctgcctctgattcatattctgtatcatcattggttgtttatgtgtctgcctcaatctcccagattggggctcatcaggggcaagagtcatctgtctcattccccttctacaaaataggcatgcagtagatgttcacggacaggacgacaccgaagccagcaaggctgagcagctggtggaaggctggggagctcttccaagcatccacagctactccctcctgctcactttattacaccatctctgtttatcgggtgtttattacttacttgatttccacgtgtcattctctagagactttgtaagtgactgactgtgttcacccctaaaacttggcagaagtcaggctttgtaaatatagtggaagaaaggagagtcacagctaagagcttcctaatgaggacactgcgaacatgttattttcaacattcaactcctaagtttgaataattcatgaaaaaaaatctgttgaactagaagtgactgggctattttaatgaaagtagagatttggaatgttttagagctgcagatcaacaccctcagttttcatgagagaactgaaggcagggagaggaaatgaccagcccacaactcagtgaattagtgagctcgggtcttctgtgtcccgtgccctcaaggtcacacagcggctagtggccaatctgaaactagaactcaggccttgagattcacacacctagttctttccatggagccaccacaatttgtcacagggacaccagagggtaggcaggcccaaggtccctctctcctgcacttctgggtcacagaagacacagggagatcacatttcctttccttttccatcttcagtgatcaagcccagttgctttctgctctggctgcatatgagacccccggggagctttttaaagattctgatgctcaaaacccaccctaggtcaattaaatccatctggtggtgggacccaggcttcagtgttttaaagccccctaggtggttccaatctgcagctaaatttgagaaacattgggtctagcctgtccctctcgtttctcctattctcttaaaggccagcatccttcccttgctccctctgtttcctttttgctaatccttgggttgtttttgttttgttttgttttgtagagggagtttcactcttgttgcccaggccgaagtgcaatggtgtgatctcagctcaccgcaacctccgtctcccaggttcaagtgattcttctgtctcagcctcctgagtagctgggactacaggtgcatgccaccacgcccagctaattgttgtatttttagtagacacggggtttcaccatatttgtcaggctggtctcgaactcctgacctcatgatccacccgccttggcctcccaaagtgctgggattacaggcatgagccaccgcgcccggcctaatcctcaggttttagcattgcaatcacatggttaagttcaggctgctgccattccaagccatttaagacattagccaaaaacttagctttgtggtccccttctcatctactcctctctctctcagcttggctgggtctttgcttcctttaccactgcctcccctcagcccctacccaggccttactctcccaggaggggctaccatttgtagcccttctctcaaagcctccctcctccttggcttcatccccagattagtatgaggctggactagaggaactgggagctcaggctggatggaaagctttggggatgctgttcctatgattattggtcccagaggaataattcttccagcagctcttcttttttttcttgctggctaagtgtgtgggtgtgcagcaggcatctgctagggaatgtcggcaaaaaataaaacttttgaagcttcaattctgcagacagattgagaggcctcccaacagtgcagaattgctgaatctggctccttccacccacttacccccccaggaagcggtaggtcgagttcgacgtgttttgatttgttaacagtggcctagcttatgggagtttaactcataagtgtgacgcttgaagataaactagtcaacaaataattattgaacattcattgcatgcagggcactgtgctaggcactgataaaacccagatggaaggtcacctctgctaaacgtattttgtgggcaatgaaaggagacaggaagagaggggagtaggaataggaaggaaataaaaatccataaaagggaaaagggttaggagtggcaggatgacagttgcgtgtttaacttcccaggacttaaagtcctgaactatatgtccagtccattctcaccaaccatattggagccaccatattgttttaatcttgtcatttgacctccaagatactttgggggcccctcagggagcttagcaaacattatcctaagacagctgcagcttctttctcaatgcgtctccatctccctcgcgcgtgtctttttgtcactttctaactcccacgctttatctcccttgctatctcttagatagataacattttttcatgaatacataaagaaataaatccaagctctcagccatttatcaaactaataatgaatattactggtggaaatgaccaacacaaattaacagctaaaactacacatagaaaaaaatggttattgatggaaaattgcctgaagaatcaaatcttcttgacaaaatgtagacatccaaatatgatcaagaaaaattggattcggtagaaataacgggcacaaagtaaaatccatgaagacagatattataattggtaaaatttgacatggacaataacttgataacgaatccaattttgtcaggaaatttaaacagagacaggaggattgcttgaggccaggagttcaaaatcagcctgggcaacatgtgagactccatctctatttagaaaaaaaaaagaggctgtgcgcagtggctcatgcctataatcccagcactttgggaggccgaggtgggtggatcacttgaggtcaggagttcaagaccagcctggccaatatggtgaaaccccatctctactaaaaaaaatacaaaaattagccaggcgtggtggcggtgcatgtaatccaagctactcgggaggctgaggcaggagaatcgcttaaacccaggaggtggaagttgcagtgagccaagatagcgccactgcactccagcccaggtgatggagcaagactctgtctcaaaaaaaaaaaaaaaaaaaaaaattgatgccaattaagataacatcaatacaatatatacaaaatggtaaaaactagaaactaccgtatgaaaaattgatcagtgaatttcattactaatgacatttgttctagaaactcactttcttgatggaagtctgtcaatgctggcataattctgatgaaaatatttatagtcaaatttccagtgaggtaacaataacagtgaaaaatatcatgaccccacaggagctgcctgatgaataggcagcaaggcgaaaactagatcaccacccatagagtggggcttaggaatctctttctttaaacaaacaaaaacagaaacaaaaatcctccatcttttgagctataatgtaaacgaaccaactattaacaaaatgtttggggaacaaccagaaaaatttgaacacggacagaatgctagagagtattaaaccgttgttattattattataggcatgatgatggtgttgtggtcatatatttttatagtcctattgtggactgaatatattcccccaaaattcatatattgaagcctgaacccccattttgactgtattagaagaaggacctttaaataggttacaggggctaaatgaggacctaatctagtgggagcagggtggggtcctaagtgtccttataagaagaagagccatggggtagggcactagcataaagaaaaggctatgtggggacacagtgaaaaggtggccatctgcaaggcaaggaggctggcctcaggagaaaccaaccctgccggcaccttcatctggacttctagcctctaaaaatgagaggaaaatattgtctattgttttagccacccaggctatggtatttgttatggaagcactagcaaactaagatgaatccttatatactagagatacccactgaattatttatgagtggaataatatgatgtctaaagttttgctttaaaatactccagaaataaaaattgaggatagcagatagataaaacaagactggctaaggttgacagttattggagctgggtaacaagtacttggaggtacattgtactattattctcttctactgtggactatgtttgaaaatattcaaataagttttaacaaattgacatggacaattgtacaggtgatttttatgtatattcaagtagataattaccaagaaaaggtttcccataatcttgtattctaacctgggctgctgtggcctggaataaaatgtcacaaatatatatttataaataaaacagtcactaaatataataagggaaaagaataaaaatgcccactgcagacagtggaactgtgggcaaggggcaagcagtcagagaaggaggaatcagcattcattgagtgcctaatacataccaggtgctttgtaaacattgtctttggatactcacataggtttatgaagtagacttataattttcaatcctttaaaaacattttaatatgaagaaactaaggcccagggaggaggaatgaattcctaagatcacacactaggaagtggctgagctgggattttaatcctatctgtctgcttccaaaacttgcattcttttctctgtacaataccttttccctagatattgccaaatatcagatcataaaggacaggaattctgaagaggataaaatcgtagacagaccattaccaaaggagttggacttggaggtaagtcctggaagtggagaaaagacatgcaagcaacctaggagtggggagggatggcaagatgcagaaacttggtggcaggtggagaatggggtaagaatgagaggccaccactgcaggctcatatttcttgaatgaagggatagaccagatgatctttcaaatctaaaattctgtcaaccctcatctgagcctctccactaggatgttccaccttcatctccagttctacatttttaaaactagattcattactttctctcctccccacctgaaacaatttcctcctggattccctcacctgctgataggattctctcacccacctacatttaacacctgtcatctttaccaatcttgtccaggcccaagtcttgggacagcactggtaaaagaatcctgataaaagtttgtgtcactcctttgctcaaaactctaggagctcccctatctgttccttgaatacctaagccatgttctggcctcagagcctttgcactggcagttctctctacccagaaggctcttctgccagatatccatcttaatctcctttacgactttattcagtgtcaccatcccaatgagaccttccttgaccacctgttttaagttgcacctacctgcgtcttcccctgctgcatgcctaatctcttataccatgatctactatttttccctcagcacttgtttctttttaacacactatttgtttttcttttctcttaaaaattgtgtatctcccttcattagaatagaagtcagacaagggcagggcttttgtccaatttgttcacttctctaaccctaagaattaacaacaatgcctgggcgcatagaaatttctcaatgaatgaatgaatccatgtcttataaatgaagtacagcataacatggaaactaataaataaagatatggataaagttctggggaaaaaaatggctgtcagttctacccaccttggagtgtcaggaaaagtttcacacaagaggtgacaattgagctgagacttaaatgtaagtgggccaaggtagatggggtaggtgaataatggtccccaaagagatcaagtcctaatccctggagcctggggttataggatgtattagtccattctcaggctgctataaggacatacccaagactgagtaacttataaagaaaagaggtttaactgactcataattctgcaaggctggggagacttcaggaaaccttacaatcatggtggaaggggaagcaaatacatctttcttcacatggtggcaagagagtgaaatgagagttgagtaaaggaggaagccccttgtaaaaccatcagatctcatgagaactcactcactatcatgacaacagtatgggggaaactgctgtcatgattcaattatgtccacctggtcccgcccttgacatgtggggattattacaattcaagatgagattttgggtggggatgtgtccggaatttattccttctggtgggttcttggtcttgctgacttcaagaatgaagccgtggaccttcgtggtgagtgttacagctcttaaagatggtgtgtctggagttccttcagatgttcagatgtgtctggagtttcttccttctggtgggttcgtggtctcgctgacttcaggaatgaagctgcagaccttcacagtgagtgttacagctcttaaaggtggcatgtccagagttgcttgttcctcccgatgggttcatggtcttgctgacttcaggaatgaagctgcagaccctcgtggtgagtgttacagctcataaaggtagtgcggacacaaagagtgaggagcagcaagatttattgtgaagagcgaaagaacaaagcttccacggcatggaaggggacctcagtgggttgctgctgctggctcaggtggccagcttttagtcccttatttggccccgcccacatcctgctgattggtccattttacagagtgctgattggtccattttacagagtgctgattggtgcatttacaatcctttagctagatacagagtgctgattggtgcctttttacagagtgctgattggtgcatttacaatcctttagctagacacagaatgctgattggtgcatttttacagagtgctgattggtggatttacaatcctttagctagacacagagcgctgattggtgtgtttttagagtgctgattggtgcatttacaatcctttagctagacacagagtgctgattggtgcatttacaatcctctagctagacagaaaagttctccaagtccccacctgacccagaagcccagctggcttcacctctcagggacacagccaaaccatacaatgtggcaaaagagacttaacagatgtgactaagctaagtatcttgagatggaaatattattctgtattattcagcgggaccataaatggaatcataagtattcttataagggagaggcaaaggtagatttagcagcagcagcataagcagaagttgatgtgacactagagcaagatgctgtgctgctggctttaaagatggaagaaggagtcatgagccaaagaatgcaaataatgtggctctagaagctggaaagggcaagaaaacagattcttcccttcagcttgtggagggagcacagccctgctgacaccttgatttcagctcagtaaaactgattttggactctgacctccaggaattgtaaaagaataaatgtgcattgttttaagccaccaagtttgtggtaatttgttacagcaaccattaaaaactaatacagaaggtgagggcatcctattaggagggaatagtatgtacaaattgtgaaagtgacagcattttcaagacacccctgggaaacttaatgtacttgggttaagcagtagggagtagagaaaggtggggttggagatgtggcaggagctagattgtgaagggccttgcatgtcatgtagaagagttgggtggtattctattggtatagggaaatgtaatgaccttcagtcctgaatggcatattttcctggctgcagggagtgctgctggcagatggcccttacttgcaactctcttctggaatctcttttttatgcatgcagctgtctatcccaagctcataccagcttcctggggcaaccaatgagtggtctacacagaagtatactctgtcatttcactccaattcagaagaactctgaagggccatcccaacttcagagcttcccaggaggttagctaaagctttgttgtgatgactttggagctcaacttccctgtgtgtccaatcctgccttcttctctctcttctacaggtattaatcccaacagccctccctaataaacatcctgcctgctagtctttgtctcattcagcctccttgggaactcaccctgccaataggggttaaatggtctttaagtaagagaatgaaaggtaagattggtttgggtggtgataactcagatcagtgtgaggacgcgctaggctggggagagactggaggagagatcagttaggaaactggagcaagattccaggtgagagatgatgaaatcctgggcaaaggtagaggcaaaagcaactctaggcatggttgtcagctttcctgtgaacagcctcttgaagcctagtccatagcatgttaactaaaagttcttcctcataggcaacacaagggaaaatagacaaattagattatatcaaactaaaaaacttctgcacaacaaaagaaagaatcaattgggtgaagagacaacctatggagtgggagaaaattggaaacccattcgataaagggttaatatccaaaatatattaggagcccaaacaactcaatagcaagaaaacaacctgattttaaaaatgggcaaatgaactgaatagacatttctcaaaagaagacatacaagtggccaacagatatatgaaaagatacccacatcactaatcatcagagaaatgccagttaaaaccacaatgagatatctccttacacctgttagaatggctactatcaaagacaaaagatgttggtgaggatgtggagaaaagaaacaattgcacgctgttagtgaaaatttaaactagtacagctattatggaaaacagtatagaggttcctcaaaaaaataaaaacacgactaccatatgattcagccattccactactgggtatatgttcaaaggacatgatatcagtatgttgaaaagatatccaaactcccatgttaactgcagcactgttcacaatagccagatatggaaacaacctaagagtccatcagtggatgaatggatttagaaaatgtgatatatttatgagaaaggcatgttgaaagctgagatgggccaaaagctaagcctcttacaccagttagtcaatttgtaaatgcaaaggaaaagttcatgaagaaaattgcaagtactacttcattaaacacatgaataataagaaagtgaaacagccttactgttgatgtggagaaagtttgagtgatctagatagaaaaccaaacagctacaacattcccttaagccaaagcctaatccagagcaaatcctaagtttcttcaattttatgaaggctgagagaggtaagaaaggtgcagaagaaaagttgaaagctggcagtggttggtttataaagtttaaggaaagaagccatctccataacataaaagtgcaaggtgaagcagcaagtgctgatgtaaaagctgcagcaagttatccagaagatcaagctaagataattgataaaactggctacactaaacaacagatttttaatgtagacatacaggcttctattggaaaaagatgccatctaggactttcatagctagagagaagtcaatgcctgccttcaaagtttcaaaagataggctgactctcttgttagggactaatgtagctgatgactttaccattgacaccaatgctcatgtcccattccaaaaatcctaggatccttaagaatcatgctgaatctactctgcctgtgctctataaatggaacagcaaagcctggatgatggcacatctgtttacagcatggtttactaaatattttaagcccactgttgagacctactgtgtagaaaaaagattcctttcaaaatactaatgctcattgacaatgtacctggtcacccaagaactcttatggaaatgtacaaggtgattaacattgttttcaggcctgctaatacaacatttattctctagcccaaggatcaagaagtaatttggactttcaagtcttattatttaagaaatacttttaggccaggtgtagtggctcacgcctataatcccagcactttgggaggccaaggtgggcagatcacgaggtcaggagattgagaccatcctgactaacacagtgaaaccccgtctctactaaaaatccaaaagaaaaaaaaaaaattagccaggcgtcatggcaggcacctgtagtcccagctacttgggaggctgaggcaggagaatggcatgaacctgggaggcagagcttgcagtgagccgatactgcaccactgcactccagcctgggtgacagagtgagactccgtctcaaaaaaaagaaaaaagaaaaagaaatacttttagtaaggctataggtgccatagatagtgaatcctctgatagagctgggcaaaataaattaaaaaccttctggaaaaaattcaccatactagatgccattaagaacagttgtgattcattggaggaagtcaaaataacagcattaacaagagtttggaacaagttgattcccctcacaaatgattctaaggtgtttaagatttcagtggaggaagtaactgcagatgtggtagaaatactaagagagctagaattaaaagtggaacctgaatatgtgactgaattcctgcaatcatgataaaactttaatggatgaggagttacttcttatggatgagcaaagaaagtgatttcttgagatggagtctactcctggtgaatatgctgtgaacattgttgaaatgacaacaaagaatttaaaatattacataaacacagttgatacagcagcaacaggatttgagagcactaactccaattttgaaagaagttctggcctggtgcggtgtctcacgcctgcaatcccagcactttgggaggctgaagtgggcagatcgtgaggtcaggagattgagaccatcctggctaacagggtgaaatcctgtttctactaaaaatacaaaaaattagccaggtgtggtggcacacgcctggagtcccagctactcaggaggctgaggcaggagaattgcttgaacctgggaggcaaaggttgcagtgagccgagatcgcaccactgcactccagcctgggcgacagagcaagactctgtcaaaaaaaaaaaaaaaaaaaaaaaaggaaggtctactgtgggtgaaatgctatcaaacagcatcacatgctacagagaaatctttcataaaaggaagagttcattgatgtggcaaacttcattgttgtcttcctttaagaaatcaccacagccaccccaaccttcagcaaccgccaccctgatccagtcatcagccattaacatggaggcaagactctacaccagcaaagattacaactcaataaaggctcagatgattgttagcatgtttttagcaataaagtatttttaagttaagctatatactttttttagacataatgctatcgcacatttaatagactatggtattatatatatatatatatatatatatatatatatatacatgtatagtgtaaacataacttttatatgcactgggaaaataacaaatttgtatgactcactttattgtgatatttgctttaatagagtgatctggacttgaaccttcactatttccatggtatacctgtattcttgaaaacccctgacagtagattttaagtgttcttacccccaaaaaatgataaatctgggaggtagtacacttgttaattagctcaattcagccagtccacaatttatacatattttaaaacttcatgttgtacaaaatatataaagtttttacttgtcaattaaacaataatttaaaaaagaagttcgtctttattatggcccaaatctgttcattttgtccctcatttctaatccagctttgtggaacatgtctactttcttaccaaaaatatcttctctgtttcccaggcgaacagtcagcttcaacaagcagcaggtttgatcaaccattcttctcagagcaagaaacctaccatactggtaagtgttcttctttccagttctccttgaatatctccagtgtcagagagctcattatcttacgaggctgtgtattctcattgatatggtttggctgtgtccctacccaaatctcatcttgaattgtagtttccataatccccatatgtcatgggagggactgggtgggaggtaattgaatcgtgggggtggttacccccatgctgctgttttcatgatagtgagtgagttctcacaagatctgatggttttataaggggcttttccctctttgctcagcatttcttcctgctatcatgtgaagaagaacgtgtttgcttccccttctaccatgattgtaagtttcctgaggcctccccagcctagcagaactgtgagtcaattaaacctctttcctttgtaaattatccagtctcaggcagctctctgtagcagtgtgagaatgtattaatatgctcagtctcagctgagagccttttatactaagtctgaaacttctcatagctttcacttggttctagttgagacatatcatcagcatggaacgtgtttagaggtcctagttttggagtcaaacagaaattggttcaaatccggattctgctacttaaagtgaccttggtccttttatgtcaactagtttgctcaactgtaaaatggggacaaaaatagaatctacctcataaagttaccattaaaaaaaaatatgttggccgggcgtggtggctcacgcctgtaatcccagcactttgggaggctgaggcgggcagatcacgaggtcgggagatcaagaccatcctggctaacacagtgaaaccctgtctctactaaaaacacaaaaaattagccgggcgtggtggcgggcgtctgtagtcccaactactcgggaggctgaggcaggagaatggcatgaaccccggggggcggagcctgcagtgagccgagatcgcaccactgcactccagcctgggcgacagcgagactacgtctcaaaaaaaaaaaaaaaatatgttggcccggcacaatggctcacgcctgtaaccccaacactttggatgccgaggcaggtggatcaccaggtcaggagttcaagaccagcctggctaacatggtgaaaccctatctctactaaaaatacaaaaattagctgggcgtggtggcacacacctgtaatcccagctactcgggaggctgaggcaggagaattgcttgaacttgggagacagaggttgcagtgagccgagattgcaccactgcactctagcctaggtgacagagtgagactctgtctcaaaaaataaaaaaaagaatatatttaaagcatgatacctggcacgctgtgaatacttaataagtgctagatattattatggatgttagatgtcaattgaatgtgtctctccaaaaggcattgcattatgatatgtgccctcttcaggggtggcaggggaagcagcaaaaagaagttctgtctccttattgagttgtgagtggatacatacctgacctctttgaataaaatgcatgttaagcacagtaatcctgtgtagactctcattcaggacatgaggctgtaatcaaggtgcctctcatggcttatatctgcctacttaggaggaaaaaagaatttgttttccatttaccaaacagcagccctgcataataagaagggattgattttctcagcgttccattagctctgagtatttcaagagagcataatgcattccagtgggggacatgaattgcatcatcagggagctggaaagggacctggagaggaatcaggctggggtagcagctttcaaagggaataatctcactcttctccacattttccttatatgttttttcaaaatctttgaagcatggcattttgtatccacatttctgatccagacacatgtttcataaccagttcaactgctgacccagttaaataataatgagtggattctcataaatctcaactttttctctcagaagaacccagtggaagaggctacagagtggtggctgtgggagaagtcatcactggtgatgtcaaaacccattgcttgattggtggtgctaaagatgagctgtctgcccatcaaaatcaccagtaggagagaaagaaaaatttagttaatctgttggttgttttgtctacctggtattcacacaagtaaaaaaaaacagagagaagaaaatactgtcttccacagaatggagtgattttttttcctcatagaagaaaggttgcttcctggaggtttttatgggaagtatagtataaccagtagtgtgatggcaaatgtttaacacagacactagcaggtgaagggagcctgagttggtagaaagtgctcatttttgtggtgtatatgttttcaccatagtcaatttcaagctaccaacacaacatcactgagtgcggtattgggagagatgagcagaagcacaccattctgtagtgtttccaccatccctaacctgtgagatcactactcactcacacactcactcagtcattcatcttttatttattcaacaaacatttattgagcacctgctgggcactggaaatactgaaatgcacaagaggctctcaagatagacaagagagctgatgactacagggggatgtaataaatatacgacagagttaggaatgggcaaggtgactgggaggaagagtggcctcttggactggccattcagtcctccagctgcttcattggagagtttgacagtagatccctttccccagcttgatacactctctttccttggcctccaggacaccattctctcctggattttctcctgtcttgttggcagcgccttctcagtctcctttgttgcttcctccttagctctatgacctctaaatgttgcagtgtctcagattccagtccttggatgtcttctcttttctacctccctcatccaatggtaatttatccagtgtcaagattgtagatcatccacggcccccagctgtagatcctcccgcaaccctgaacaccagactcatctgtccaactgcctatttgaaaacccccatatggctaacaaatgtctccaacttaacatgctcaaagttgaaaccctgacctctgtcctctgaaacttgctcctcctccatcttctccaccccaggaaatggccactctcactctacccctccagttgttcgggggctcaaaacctgtgagtcattctttccttctctaacgccccaaatttaatccattggcaaagattgtggactgtcttccaaacatccaagaagcaactgtgcctcaccccctccaccaccttcaccatggatcatgccaccattgctcacctgatttactgtatgacctccaaatacatcttcctgcctccactcttgtccactgctgccccacccacaacacacacctatattcaattctcaacatagcagcccaagtggtcctgttgaaaaataagttagatcatttcattaacctcataggattgttatgggtattgcaatgtctggcacatgacaaacattcaatttttgttagtattattgttgcatttaaattaagaggctattcattatactgtgtgatttctttttgtttgtttgttttcggagacggagtctcactgtgtcgcccaggctggagtgcagtggtgcgatctcggctcactgcaagctctgcctcccgggttcacgccattctcctgcctcagcctcccgcgtagttgggactacaggcacccgccaccacgcctggctaattttctttctctttttttttgtacttttagtagagacggggtttcaccgtgttagccaggatggtctcgatctcctgaccttgtgatctgcccgcctcagactcccaaagtgctgggattacaggcgtgagccaccacccctggcctatactatgtgatttctaatatccgattttgttagttcttacagacaagtagcttgtgcttcaaacatcgcacccacaatcatgaaggtagcaggtcttcagttcagagcagaggagatgttgagctgcaatacaaatgtcaccctcagaaggtctattttaataatggagactaatttagtttagaaagcaaaaaatttccaatttggcaaattaaggtataattaacatgcagtaaaaatcatggattttttttgtttttgtttttgtttttttggagataggtcttgcgctgtcacccaggctcaagccacctctgcctcccaggttcaagccatcctcccatttcagtctcttgaatagctgggactgtaggtgcacatcaccacgcccagctaatttttgtattttttgtaaagatggggtttcactatgttgcccaggctggtcctgaactcctgagctcaaaggatccccccacctcagcctctcaaagtgctgggattacaggtatgagccactgcgcctagccaatttatcctttttagtgtacagttccatgagctttgacaaatgcatacagtcaggtaactgtgtcacaggtactttatcacaacttgataaagtttacatttctcttgagtaaaattgggattactgggtctacctgtgttgtgggaaaacttatattttagattattcttgaataaacatagaactattactctcagattcatgatgtgaaaataagtaattcaaaatctaagctgttggaactataaaatattttgagccttaagggaatgtgattatgggacctgagtcacaaaaacaggcagctataaccttttgtgtctctgattatagattagccttttttccttacctacattgttttgtaatatgttggaaattactaacgggcaccgaggtaggaaccccttctctcttaactattgatctttgttgtaggttaacttccctctttcttctctcacacagacttcttgactatcatattgtctaagatgaaatgttaaatatattacttcaaattggaaaggagaaaaaaagctggatataaaagaaaaactgtaattaaattgttttaactcgtaaaccaaccttgtatagaaaatgtcataatcctattaaatttttttgtttcctgcctatataagcaagaccttaatttttaactttggagtattgaccccattcctttgaagcctgtgttatccaaatccaaatggccattctcagctttgcgcttgaataaactttttttttgagacagggtctcactctgtcacccagactggagtgcagtggcacaatcttggctcactgcaacatccacctcccaggctcaagtgattctcctgcctcagtctcctgaatacctgggattacaggtgtgcgccactacccaccgggctaatttttgtatttttagtggagatgaggtttcaccatgttggctgggctggtcttgaactcctgacctcaaatgatccacacacctcagcctcccaaacttctgggtttacacgcccagccaatagactcttttaaactgaattctggtccttttgattatttcaggttgatgatgtaatggttgattttatacatcaactttactgggctaagggatgccagatagttggtaaaacattatgtctgggtgtgtctgggagggcgtttctggaagaggtcagcatttgaattgacgaactgagtaaagcagattatcctcctcagcgtgggtgaccatcatccaatcctttcagaacctgtgtagaacaaaaaggcagaggaagggcagtgaattgttgctctctttttgagctgggacatccatcttctgcctgtgaacatcagtgctcctggttctccagcttgcagacagcagatctcttggcctccataattgcatgagccaattcttacactctctctccccgcaaactcctgtgtctatatatatcatctgggttctgttgctctggagaaccctgactaatacacatgacaaagactgatgtaaagggtaaaatcattctgtgccttgaaggatcttctatgtgtttcaatcagtaggaggagtgatgtgtaaattagcaaagtcatcatttgcaaatggctcttttcaaaataattttataagtacttaaaaatagtttgttggccttccttcttaagaaagataaacatttcctttgtttacacatattgatttgctttataagcaaatctactgagtgcaatttctacagagagcgcaaaagtccagcctgcttaaacactgtgatcaccttgtagtgcatgaggtcttgccatgctcttccaggtcactattctataaccaaattgggcctaatccagactaaggtgctctctgctcattttaatttaatttattttttttaattagcaaattttttttaaaaaaataacaagctttttaaaaaagaaattagcaaaaaaattttaaaaaataatttagctatctgtttgttaaacacaacatcattaaaaaaaattttggaggtctttccttggaagggtgggcaaagctggaggcagcctactgtaggaagaagatcccaggccagaagttagaagacatgtagtagttctagctctgatcacaactagttatgttaacttggcctctttgggtattagttttggataggacaagggtaaagtgagagggatacctaggctggagaatttaaggatatactttcaggactgactgcacttactttatcctgaaaatgagtgccgacttaaattttgtaccttagtttctcatttgtctttctctagccctaggtttactcagtttccttgtctgtgaaatgaggagccaggctttgttatctctgtaatctttcccagggctaacattttatgtcccaaacctaaagcttaggccaacatagaaccagtcaaagtaagacacgtgtaattacccagttgaacctggtcaatagtctagctgaataattcagggcaaaagtaccctgtttttctgcaataggagggtggattttctttgctctgcagttcaagaaggttgtaggaagagtcctaagttaccctctatcttaattatatcaacagtcctagctcactggctccattgcttttttctgacttgcagcccaggccatccacaaattgccatgccatctcttgccctgtgatgatacattcacttgtgcaatccagaaattctcaaatgtgtgtgttggtgagggagggtagtgttaaggtgtacaactagctgtgccccctaggggtgatatttattttattttaaatttcacataacttgaaaggaagacctgagtcagtggcatgcagaatccactcctactagttggtgagagtgactgttaaaatttcaagaatttagtgagctgcttgttaaacacaacatcattaaaaattagataaacttacaattaaataaattatattaaaaacaaaggtaataaatagcaaaatttcttcacttcctaattgttttactacattaactattacgttcttgaggttatttacatctattatatatgtatagtagaaatactaaataaccatgtgctacttactgcacatctcaactctatgttcagtcacatcatatggtagctggaaatcagacacactgggagcatttacaccatggaaattggcagatgctttgctagggctttgccagggattttcacttgcttaggttaacgaaaaagttgaaaaatatgttacttgtgatttacccttgccctatctatataaagcagcttcatgtagtggaaagagctctgcatggactggttctgctaataatttgagaataccacctctgtccttcaacatcccccctctctggagcaggcaaaagtataatattttcccttgttatctcataagattattaggataataaatgatcatttttgaaacaaaactttattttttaactcttaaaataattcggtggtttatgatttgtagtttaataaaagggcttaaaaaaagtgaatacctttgtcttagtcctttttgtgctgctataatagaatatcacagccatagtaatttataaacaattgattttgtgtatgtgtgtgtgatggaatcttgctctgtcagccagactggagtgcagtgaaatgatcatgactcactgcagccccaacctcctgggcccaagtgattcccccacctcggcatcccaagcaactgggatcacaggtgtgtgccaccacgcccaactagttttttaattatttgtagttacgaggtctcactatgttgcccaggctggtctcaaactcccaggctcaaatgatcttctcacctagacctcccaaagtgctgggattacaggcatgagccactgtgcctgaccaacaatagaagtttatttggctcatttttctgaaagccatgaaggccaagatcaagaggccacatcttgtgaagggcttcttgcaccatagtaacatggcagaaggcatcgtatggcaagagagtgcatgtgagagaggaaagagagtcaaactcactcattataaggatgctgctcccatggtaatggcataaatccattcatgagggcagagccctaatgacctaatcgccccttaaaggtcctacctctcaacactgttgctttggtgattaaatttccaacgcatgaactttggaggacacattcaacccatagcaaccttatataaacaaaaggtgttgttgcaaaagatcacacagtcacaagagaatggttaatagatatgaaggcataaagctagaaaaataaaaaataaaaaatgcatgggtaagacgaagggttattaataactcagaattttatgttaaaattattcatttgtacgcatttttttctccatacacaaaaaatgtgtgaacaaaatgtaaaaggattcatttagcacctaatgctgtgatttatttgttggagcaaagtggtagagtgccaccttacctccttcctcaagtctcacacttgatctgcagttgcgaactgtaagcttgggccagagagggacaatgtctgctctctatttctgcccacttgaggccattagacataaccttgagtggtctgagcccagctgtggactataatctcatggtgtgggggtgggggtgggtcacaaagttatgatacaataataagaagtctgaattcatttcaatcccaaaagctttgtctgtagaataaagaatgattgttttttaaatgcatctagacactgttgttatgaatcaaacacaatttcacttcaaagccctactgaatccgtagtgtctttctgttaccagtgctaaagctgagctctagccaagagcacccagctgaggggcctcacacaagggctggaagcagtcacaactctcctccatgagccatttgtcctgttttggtgctgagtcatccctgagaggaagcactaccattttctaatggatccatataattgatcctcttttacttcatttcataaagccatgcaaatagtagcaaggactctataggaattatgtatgttcttaatcaacagatattaacaaaacaccaccagagtacaagtgtttttgctatcagaaaaagaggtgttcatgtctaaaaggtttggaaaaccctgggttgagatttttgagtctgtctggactaatatttccaattctcctccaaaatgtgtgtctgtttgtatgtgtgtgtgtgtgtgtttgtgtgtgagagagagagagagacagagagagagagagaggaagagggatctatctatctatctatctatctatctatctatctatctatctatctatctagaatgagattgcaaagctcacccccaatagagatcagggtaactggattttaccagtctctattctttctcagactctgatgaagattctgctaatatgatgtttgtcatagattcattcaaaatctaccagttagcttttactgcagagtaagacaccttaaaatatatgttaaaacaacaaacatttattatttctcacaaatttgtgggtcagctggaccagctcatttggggctaggtggtctagaatggcctcacttacattatctgatggttggctggggggcagtggggatacttggctgggtacttttcatcatccagcaggctagtgtgggcttacttacgtggtaatggtctcaaggctcccaagagcagccagagagcaagccctggtgtgtaagtgtgcaagtagtgtgacatcctctgcctgtattctgtttgctaaattcccattggaaaagtaacgtgtccagcccaaagtcagagtgggaggacacaaaaacagcatggatagaaattgtgatcatgatcgcaaattatcacgctcattgattttaaagacattagggaacaaaatcctatttccaatttccattagagaaaaagaactgttttctgctttgtctaacattatggctatgtaattttgaattttctataacaataaaaaggaaataagacagaactaatttttataatgtattttatgtaatccaatgtatttatgtaattcaatgttattatttcagtatgtaatcaacataaagagttaggaggtcttttttttttatatgagcctcttaaacctagtgtgtacttcatccttacagcataccagaatttggacttgcaacattttaaatgcaatggacccatgtggctagtggctaccacactagatggcacaacttgataatatagacttcatttctttatttacatgagaaaattgaggcttagagaggataagtagctttcccaaggtcacatggctcttcagtggttgggccagaattcagctccacactgatttgacatggaaggctttgctctttccactataccacattggctgcatcaacaggcttttgatgagatgggtagaaagcacttgtgccacagtcctccttttgaaatataaactgctcgcctttcccttagtctgcggggtctaattctttgacttctggggccttccacgatttagcctttatcctattcattcattcgtctcctttcccaaaatatatcatgctaacctgggaattggaagacatgtttcactcctgtactacctccctttgggcctctgttcatcagtgctttgatatgtatgtgctcttctttctttcttggtggttctcaagagcaagagctatgtcaatgatttctcttttattctcctactctgtatgcttattcttgtactttgtaagctctgatgtacagcattttgtatagttcttttttgggagtgggagctcaataagtcagtgacccaactgagctgacatcagagaaagggccaaggctgctccacagagggatctaatgtcccaaaggatgtaaacctagggatgttagacgatggcctccaagtacctgcttcctctggaaggaaggaaggcagctggctgacacatggctatgccatgaacccggggcagcctggcacatcacaggccctcaatagatgtttgttggaagaacagattccatgtacttctaagttgatttgagctcaaagcaaggagggattgacacactgtcctccatcctcacaaaattgataaacatagcatttttataacattaggtaaattctgaatgtaaacttagtggcagaatacaattggatattattgattgacaattaaaatagcaattaaaaactgcccagtctctaaatgatctttttcaacattacatctatttttctatctgaacagaatatctatatttttcaacttcttttatgttcccctgatgaaaaaatagcagttaaagactgcttcactctgattaatcctttccaatattttacctatttttctgtttgaagagactgtattttaaagctccctgtgtattcctttgatgaaatattggagcagttttggttcctgaggtttctttttttctttccatttaattaagctgattagtatcccatatggagtggaaacaattgttttcagatatgctagcatacagttacccaaggagctgcaattgtttacatgtttctaatttccttatggaaattcttagactttgttagataaagatctggcagactctaattttgaacattacagcctttggttatcagacatggctatatcctgttcagtggcctctgggataaaatagtatattctacaattttcgttccatagagtgaactttcaaaagcctacccagcatccatttcctcttgcctgtttctaacagcactctgatttttgttcaggaatacctctacccgcatgcagagctgaggtttagggaagctgaccctgccttcagctgcagtgtgggcctcactgttctatgggtaattctactcctttgccacagcggaatccagaccttagataatctatgggtggcattcttgggtcaaggggattggttcaggaatgggcatgtgaccaaattgtgactaataaggtagaaggttttgtaagagtttcaggataggaggattcctaaagagtggggttactgggtaatatggtccctcttcctgtggacattgttatggccaggaaatgctactgtcacctcgctggtggcccgagtaagttgccaagccacagaagaggaaggggccaagcaaatcatagagaggcagatttggaggctgatggagccacacctgacagctacccagcatctggactctttcagttaaattaaccaataaatcccctttagggtatgagccagttggaatagagttttctattactcacagccaaatgcatccttgccaatatagacaatttcaccaaagaattgtgaatcataaaataagaactcagtcctaggaaataaaacataaatgtgtgagtgaatacagaaaagaaaatacagagcaggcctggatgtaatacagtcctcctttcttctatcttccaaatgaagaaacaggttcagagacttctgacaaagcttgcaagttacagagccaggattcctgctaggcttataagtcataaacacacacacacacacacacacacacacacacacacacacgtatatatatacatatgtacacacacacatgtatatatatatatacacacacacacataggtacacacacacacacgtatatatatatacacacatatgtacacacacacgtatatatatatacacacatatgtacacacacacacacacacacacacacacactgagctatactttgacaaattccttcagagaaacccaatgggcaatctggtaccagaccctaccttgacctaatcaaacagctatgctactcttgctatagttcttataaaatatatgaacagaaaatagtctgtatatcttcttatttttctacacaaggttctgtctcaacaacctcgccatttttctttaagtgacttggctttttttttttttaacaatttatgttctgattgctttattcgtaatgcgtagagctggtcaaaggggtcaatgaaaagaagataaatagaaactgattacagcacaaatcaaatgtgtaaataaacatcataatctcattttgacatcccaggcttgtggtcaggtatcatggtcatatgtcatccatctttcgtaggcagttcagcaatctccagtcattccctaagtgggctcagtagtgaccatctggcactggtggaccaccaagcagatgcctggtcgatgaacattcccatcatgtctcttccaggccctgagacctacacctctctcagagcaaatttaaaaacttctggcctggtatgccaggttcttggtatcctcattccacttgcctctccagcttgtggaaatgattttattttctctctctctctctcactctgtttctctctctctctctctacctctacctctatttctgtctctgtctaccctgttatacttcttctcttctaaatgccatgctcttattttcctatgcttcttattcttttttttcatcactaaagatctatcctttcttctctctgtcataataagactacctcttattgatttcataatgagaacttccaacaatctatttgtccctttatctcaacctttttggttaaacaattcaatttttttttttttgagacagtctggctgtgtcgcccaggctggagtgcagaggcacaatctcggctctgcaagctctgcctcttgggttcacgccattctcctacctcagcctcccgagtagctgggactacaggtgcccgccaccacgcccggctaattttttgtatttttagtagagacggggtttcactgtattagccaggatggtcttgatctcctgaccttgtgatccacccacctcggccacccaaagtgctgagattacaggcgtgagccaccgtgcctggccgacaattcaatttttaatgttagaacatctcaacattttcttaagatgattcaggtatttaaaagtaatttccctaaacaattatataatttttaaaagtctctctttttctattttctaataccttccagaattggataattagaaaatgtttttgagtttttaaaaaaattatttttatttccttttttaaaaattttcatttttttatttcaatagatttttggggaacaggtggtgtttgattacatgaataagttctttagtggtgatttctgagattttggtgcatccctcacccaagcagtgcatactgtacccaatgtgtagtctgttatcccttgtcacccaccccaccctttcccctgagtccccaaagtccaaggtatcactcttatgcctttgcgtcctcatagcttagctcctacttataagtaggaacatatgatgtttggttttccattcctgagttacttcacttagaataacagtctccaattctatccaggttgctgcaaatgccattattttgttcctttttatggctgagtagtattccgaggtatgtatatactacattttctttatccactcattggttgatgggcatttgggttggttccatatttttgcaattgcaagttgtgctgctataaacctgcatgtgcaaatatctttttcatataatgacttgttttcctgtaggtagatacctagtagtgggattgctggatcaaatggtagatccacttttagttctttaaggaatttccacactgttttccgtaatggttgtactagttttcattcctaccagcagtataaaagtgttccctcttcaccacatccacaccaacatctatttaaaaaaatttttttgattatggccattcttgcagaagtgagacggtattgcattccacttgtatatcttcttttgagaattgtctattcatgtacttatctcaatttttggtgggattcttcgttttttttcttgctgatttgtttgagttctttgtagattctggatattagtcctttgtcagatgtatatgttgcgaagattttctcccactctgtgggttgtctgttaattctgctgattatttattttgctgtatagtttttcagtttacttaagtctcatctatttatctttgtttttgttgcatttgcttttgggttcttggtcatgaagtctttgcctaagccaatgtctagaagggttttcccaatgttatcatctagaatctttgtggtttcaggtctcagatttaagtctttgatccatcttgaattgatttttgtataaggtgagagatgagtatccagcttcattcttctccatgtggcttgccaattattccagaagcttgtttttttttttaaatgaagaaatggtaaagaaggtaagtcctccactagactaaatatgagcatggcaccctgatacaaataatgtagtcaaattcttatctggacttcattgtctacccccaagcaatttgtcaagttattttcctaaatacagagttttcctgccaagaattctggtgacagttgtcaggcaataaaattgtaatttcctggctataaatgaatggtctttccactgacagatgacatcatattgtatagattcattcctgaagaatctattgcagccctaaagtactactacctttaccttttaaaggggctctgaactttccgaagcttactaactaaaaggatattttaaaaacttcaataatggctattatatcattatttaccatgtaagtattattgtggcacattgcaaagcattggtaatatggccatcgcagagttatcttgcctaatcatttaatcctaaggtttcttttaaaaaaaatggctcatgatccacaaagacagtaagcacataagatttcagaggagaaaacaatcgctgtagcctagaataattgaggtttcagcagtgaaatctgagttggccaggtaggattcagctgggagagaggaagcagaaaggtactcttgtctaagtgaatagcgtggacaaatctgcggtgatgagaatgcataaagcatgctttagggaacagtcagttgagtagtctagctggggtagagtatactgttgtagaaaatcttaaaactcaagcaagatagtttgcatttttttgcttctgtgagcatatgggaacctagcactggaggctaggagggagggatgagagctttaagaaggtgaacctgattgcagagtgcatggctctggaggctgggggtccattttagatgaaatgaagtcgtccatgtgcaactgcaacagcttgactgaaggagggaaagggagagtggaaatgatgagtcagagggggagatgttaggaagaaaaaggatcagcagctcttggggaccaactggaaaaggaagtccagatggagagggcatccaagatgattccaaagtttgcagccttcatcatggtggaagaaactacccttggaaaaatcaggaaagaaaagggagccaggattaggaggtaaaaaaaggaatttgttccctaatagactgagtttgaggtgacagtaagataatgaggtggggctgttcagaaggcagtggggaagaaagttaagaaaaccagtcagggctggaaataaggatctgggagctgtttccgccttaaaatggtcctctttccttcctaacagaattccacctgtgtttgggctgccatgtgcccagatggaaaggataagccatgattggccagaccccaaatatggtatctcatttccctttgattggttaaggggtgagagtgtgattccgttctggccaatgaggctaaagggctctaggggggattttttttttttttttcctcctggtaaagagaccaccatagggcggagccctgagcttccatcttcctccttcctgctagtgagcttggccaggggggcttggacactttggagaggggccgacacacggatgatgacaaaacagaaagatagtaagagcctctggttcctagtggccttgtggatttgctgaaccaagccttgatgtgctgacctccagactcgttacacttaacatttattaaatgtctttattacttaactgttggttggtattttatgattttcagcttatcttaactgatatggatataattactaatgcttgtgagaatggatgagccctgagaagggggaagagaaagacaaagcctggaaacttcttttagcagatggaaaccttttgctaattaaaccttaaggtttttaatcttaaaagctacacagaaaacttgttttaattttgaaaacataatactcctcctcccccaacacgcgcaccggacaacctctctccttgaaccactccgggtggttcaaattccaaagagcatatgtttcaaatgaaaggtcaaaaaggagatcggtttcagtttggagctaagggagagtgattatttctctaatgtgagctgcttcctgttgctaaaacactgccccttcaaatgagattgtttgctaagtgaggcatctccttcctctttcttccttggatgaattagcaagcaagaagagtcagtctgaggctcctcactgtgacggactgaggagctttatttactccctgcggatagtggcctgccaccagagaggccacaggccggagtgatggagctgactcatagggtaaggagaaagtggcctggatcgttgacagaggtaagcagtgtccaattcctcctaggcgggggagggagaggttatggcaaagaaagccgtttctattccactgggcaattaatgccaccatttttcttgaaaaagcgttttttttttcataagccgttgaggataatttaacccccatcttgacaggacgtactaatgaccgctaatggatacattcttttaataaatgaagaggcacaagaaaattgccagatattaaacagagtcccacatgtcttatctgagactataatggctctatcaagtgacccaagtgaaagaaatgtcactcttcagaggttaaaggagtctattttttcttagtgcgatataaattcatggctagaaagaacagtaattcattggtctaccctaggaaatgtttaaagggggctgtatctcaaatgatgcattttctatcggtagtaaagaaaatatgaaataggtacctctgtgcactgtggatttatgtaaatggctttttaccaggtaatatagcctaaagctctgtcaagtctctaacgcttggaatttttggcaaagaaatgaaagaacctgtaagttatcattattttattttatttttttcaataccttccagggtgtggtctttttgtttggtaattttaaactacattcttgaaaaagtttctcaagattcaagcaattcctaggactgtatgtacacttggggaacatttcttaaaatacataacgaattcaaattaataagaaaaagacaacccagaagaaaaatggacacgtgaattaatcagaaactcaagaggtaatggccaataatcctatgaaaaggtgaatgatgtgtatggtggtcttctgcaacttgcctttctgcctttccttctttccttccttccttccttcctctctctttctttttctttctttctctctctctcttttttttttttgagacagagtctcactgctctgtcgcccaggctggagtgcagtggcacaatctcggctcactgcaacctccgcctccggggttcaagtgattcttgtgcctcagcctcctgagtagctgggaccaccagcctgcaccaccacgccagctaatttaaggaggtgaacctgattgcagagtgcgtagctctggaggctgggggcccattttagatgaaatgaagtcgttcatgtgcaactgcaacagtttgactgaaggagtgaaaggaagagtggaaatgatgagtcagaatggcagacttttgacaaagttttgccatgttggccaggcttgtctcaaaacccctgacctcaagtgatccgctcgccttggcctcctgaagtgctgggattacagttgtgagccaccgtgcctgacccaaatgccattttctttctttcttttttcctgagacagagtctcgctctgtcaccaggctggagtgctgtggcgcgatttcggctctctgaaacctccacctcctgggttagaggaattctcctgccacagcctcctgaatagctgggactacaggtgtacaccaccacgcccagctaattttttgtatttttagtagagacggggttttgccatgttggtcaggatggtcttgatctcctgacctcgtgatccacccgcctgggcctcccagagtgctgggattacagatgtgagccaccgcacccggccccaactgccattttcaatataacactatgcctctgcgtttgatccatccatggtatcgtgtgtagcaacatcattttcactatggtaattattcagtggaggaacattccacaattttgttctccctacatgtagcatggttccatatttagaaagctcaaatacagcttaaaattataaaatggattgtgtatggatatatacatacctgacaaaactgcttaaaacaagcaaaatcacaataaaaaccatcttcaagataatgttttcttcatggagagggagactgacactgaggagaggatgggaaatgtatcagttatctatagctatgtaaagacccaccctaaaatagtggcttaaaacaaccagttattgttcatgattctctgggtcaagacttcaggcaaggcttggtggggatggcttgtctctggctcactcatgtgtctgcgttcagctgggctggtgggtccaagatggcctcaccctcaaggctggggccttggtgctgtgtgtcggctggagtttctcagacttcctccatgtggcttctctcttcatgtagagtttcatcttttgttccatgttcttttccctccaagaggttagcctggagttctttacaaggagaaatcatccactaatatttgtataactaaaacttgatggcaattaaaatatattaacaaaggtgtgctctgtggtccaatattgttgggaaatgttgcatatggcttctccttgtggagcttccactgcaaacagaacagaaagcttactaaagtctctgagaggtcttgcatggagcaaagaaagacaaaaggcgagatgctacgtcttttttccagggatatataaaggaagggctgggttagataaagcaagaaggctttggcttgccttatgagaacatcatcatcatcttaactctgctattcctgtacccatcagagtcccagtataactgcaggtggctccaattgccaaggcgtctgaacactcctaaaacctgtaggaagtagccactaggccaaagggtcaacagtgcttttccaggagtcaggtcatttatgtttctgcctctctccaccgtcctgccagtgaccttgtcttgaattagttcacctacttaactcctatctcttgtttgctttaacccccatgagctgctttgatcaattaccagcacgtccctgatgcttgatgaccataagttccttggattctttcctttgaaagttagtccatgttggttgtgacaaattcaaataataccaaaaagcaaaagccttcccttatctatttcaatcccccagtcccaccattaacagttgagcagttcagtttccttctagatgattttccatgtttatgtaaacacatgtgcatatatatttgaacaaaatgggtatcaacatgttcatatagttctgtaatctttttcattaatatatcatgcatattattacatgtcagtacatatagattgatctctttttaatagtgtcagtgggtggactcacgtctataatcccaacagttttggaggctgagcggggaggattgcttgaatccagcagtaagtacaagaccagcctgggaaacatagtgagactcctttctacgaaaccataactaaaaaattagctgggcatggtggcacacacctgtagtcccagttactcaggaggctgaagcaggaggatggcttgagcccaggagtttgaagctgcagtgagctgtgattgtgccactgtactctagcctgagcaacagaatgagtgtcaaaaaaaaaaaaagtgtcattacgccgaagtatgggagttcctttgtttattcagctcttttcctccggatcaatgttcatgttgctccttattattattattattttttttttggctattgtaaacaatgtggctgtgaccgcctccccacccactccatgtacctaaatctttgtacattcatgccagctaatgttctgaggaatacgtttccagacgggcagtgctggatcttaaggcatgcctggcctcctctctctcattatccttttgaccctgatatcctagagacttctgttgttacctgcctgcctgcccagatcagtctgtggttcacttgttccagggctccccagagagtcagtcgcttatacatgctctctgaagctttgtccaggcagcctaggttgctcacatcagttgacagctatgctcaattacagcacttgtcacattgtgttataattgtttttctacttgtctaacttctccactagattggaactttccaaaggcatcatcagtgtctggcacaggacttagcactcagaccaaattccttagcaaattttattgaactcacactgtgtgctaaacactagcactgtgtacatagagctatggacaaaaccaaattccctgcttcagtgggcagagacacacaatccacaaacaatcataaataatttgttagatggaaagtgctatataaagaaaaataaggcacagtacagccttagagaatgctgctgttcacaggtggcgtatatttgagcatggatctaaatgaggtgaaggattgagatggctgcttggggaagaactttccaggcatgaatgaatgcctgaattgagcatctccacttcctgatatgagagaagagacgtaacaaagattcctccagaaccaaaaggatccgagataaggctaacttgattaacgtgcttaatgtgaatgccacaccttgggtttcccaggaagaagactctcagatgaagaccagtgtttaggaagcttattaggaatgcttgcgggatcaacacctgctggggaagaaaggcagcaagattgggcagaggacagagttgggctatggtgcagtctcagtggaggtttccatcggccatcgggagttctgaagctgggctggcccttcggggtggtcccaagttgggggctggatctttatgcctcgccttagtccatcattagatgttggccatcccaggaaggagtatgaccttgggtgaggtggctcccctctgccacagtagtccttggcagctgagggctacttaaatgatttcaacttcttccttttgttcccccagcaccaggagtgatggttcctcagcagtggagggagggagtccttccttcctgaaggggatctgggtgggccagttcactgttcatcaccgtgagacaaggtggcacatggtgatggggagcacaacatgctggggtgggtgggggtgggcagtcaatagatgcaggtctaaaccttgctgcattggagagaagataagagaaaaagttgctgagttggtttcctgggcctatgtgctctcagagtcctttccttttcttagcttgcccagtggtgctgacacctgcaggctgcatctctcaaactccccatcagttggtttctggcaggtttgaccaggagaaaccactgatcagacataagcaggaggaaaccagagaaaccagagtatttccatccttcctcttcgccttgggcaggaactccattagcagcttgtcttctcccttgttctaactctcctatgcaggctcactgtggttccagctcccataaaggaatctctcagtccctggctctggccacaccactgtggtagatgtgaggtactcaggtcctctttaaggaaggacttgctgcccaacggcaggtgctgcagccagcatccagctgtcagcccctacagggtcagccttacttgcagagaaccaccttgctcgaggtcatgcccttcctgaagcagctggcatccggtgagtggaagaggtggggtgttgaatgccctgccattctggcttgttggaggacacaggtgggctgaggtttcattgggtctgcataactgtgtggcttctgcctctgcccattctgttgcttctccttccccttcccagatgttgacccctcatgaacaccttgcactccagtatatttctaagtgcttctgagagcccggcctgcaacaccacttctcccctctgcctccagcctagagatgggaatggcttcctgctggtgctaatctctaggtggcctcaccatgtcccatttggacactctgctcttgcatcatccatgtaatcaattaactgcattaaatccccatctctttaaataaagtaggttctgacacagccaacattatactgaatggggaaaagttgaaagcgttcctcctgagaactggaacaagacaaggatgttcactttcaccacttctattcaacatagtactggaagtcctagccagagcaatcagacaagagaaggcaataaaggacatccaaaaaagtaaagaggaagtcaaactgtcactgtttgctgatgatatgattgtatacctagaaaaccctaagaacttatccaaaaagctcctagaactgattaatgaattcagtaaagtttcaggatacagaattaatgtacacaagtcagtagcactgctgtacaccaacagtaaccaagctgagaatcaaatcaagaactcagcctcttttacaatagctgcaaaaaataaaataaaatactgaggaatatacctgttaccaaggaggtgaaagacctctacaatgaaaactataaaacactgctgaaagaaatcatagatgacacaaacaaatggaaacacatctcatgctcatggatgggtagaatcaatatcgtgaaaatgaccatactgcgaaaagcaatctacaaattcagtgcaattcccatcacagtatcaccaacattcttcacaaagctggaaaaagcaatcctaaaattcatatggaatgaaaaaagagcccgcatagccaaagcaatactaagcaaaaagaacaaatctagaggcgtcacattacccaacttcgaactatactataaggccatagtcaccaaaacagcatggtactggtataaaataggtacataaaccaatggaacagaatagagaacccagaaataaagctggatacttatagctaacgagtcttcaacaaagcaaacaaaataaagtggggaaaggacaccccattcaacaaatggtgctgggataattgtcaagccacatgtagaaaaaatgaaactggatcctcatctctcattttatacaaaaatcaactcaagatggatcaaagacttaagtctaagacctgaaaccataaaaattctagaagataacattggaaaaacccttctagacattggcataggcaaagacttcacgaccaagaacccaaaagaaaatgcaacagaaacaaagatagataggtaggacttaattaaactaaattacttctacacagcaaaagaaattatcagtatagaccacccacagaataggagaaaatctttgcaatctatacatctgacaaaggattaatatccagaatctacaaggaactcagatcagcaagaaaaaaacaaagaatcccatcaaaaaatgggctaaggacatgaataaacaattctcaaaagatgtacaaagggccaacaaacatatgaaaaaatattcaacatcactaattatcagggaaatgcaaatcaaaaccacaatgagatgctacctcactcctgcaagaatggccataatcaaagatcaaaaataatagatgttggcatggatgtgaagaaaagggaacacttttacactgctggtgggaatgtaaactagtacaaccaccatggaaaacagtgtggagattccttaaagaactaaaaatagatgtaccatttgatccagtgatcccactactaagtatctacccagaggaaaagaagttattatactaaaaagatacttgcacatggatgtttatagcagcacaattcgcaattgcaaaaatatggaaccagcccaaatgcccatcaatcaatgagtggataaagaaaatgtgagggataaaagactacacattgggtacagtgtatactgcttgtgtgaagggtgcaccaaaatcccagaagtcaccactaaaggacttattcatgtaaccaaacaccacctgttccccaaaaacctattgaaatggaaaataaataaagtaggttctgttttcctggctagacactgcctgatatagtgagttttacatctaaacttcagtttatattctcatttcccttgctaatctagtattttataagggggccctcaactcataaatatatattaatatatatatgtttgtgtgtatatattcctcatctgcaaccaaacgcagatcgaaaatacagtattcctggaatgtgacacccacgtgtatcaagggccgacttttcatatatgcatgttcctcagggccaactgcaggacttaagtatgtggaaatctggatatgtgagggggtcctggaaccaataccttgtggataccaagagatgactgtatatatttgctccagcagtggagatgcagcatacataagtgttttgccatgactatgcccaatgtcatacttggggtcaggttgaagcccatgctgaggtccaaggggagtgggtggatgggcacatagcggtaagaacacttggagggccgtaagcaggtgaaaagtaggtttattcagcagctctcccatcagcagctctctcaccctgtctgcctttatcttggttgtgtgctgtgactctgtggctcctttcagcagttggctctgcacctctggctgcttccacacacaggtgtatggccagctttcccttccttcagggtcagcagcttaactctttccctctgggcacaaactggtttctggctcccctctgcccgctttcaaggcgactggctctcccttacagggatcagaagcgttactctccgggcacagtatgcacactgtgttgagccatgtttagccatgccccagagtgcctgtacggtgtcagcagggcagttataccttttccaaacaatagtggctttgagccaaatatgagcttacacaaacaggttatataacaaataagagtatgtacctgcaccctaaactcgccgagtcatgcaggcctggatgtctgcctcggcctaattcttgaccaaagcacatggatgtaccttacagtaagtaagcccagcaagcagcagatgatccataacccatatgatcctcaggtgggtccttagccagcactgctcctcaccgccacttgctctcagctatccctgtgaccccagctaaaattggacatgtttggcaccagcaatccccaagctggcctctggctgttttgcactgaccttcctccttctcctcttcctccattatctttgtgtctggctctggcatcacttccctggatttctcctgagggcagagctcggagtaggctgaggcaagacaggagccaagggcacacaagttaaggacacattcacttcttaggttgtgcaagtgcaggctgggcagttcttctctttggagggttaagatgggaagctgttacacaggaggctgagtcaggaggattgcttgagcccaggagtttgaggttgcagtgaactatgattgcaccactgcactccagagtgaaaccctgtatctgtctcaaaaaaaaaaaaaaaaaaaaaaaggaagctgggactgagcttgaggctgcctggccagaagcagaggtagagggtaacccttgtatgtcagggtacaatcaggagacacatcacaccatgttttttttgttgttgttgtttgttttgttttgtatttttaacaggatttaatagaattaattgttaattaggtaaccgaaaaggcaaacttgatagaactctagaactcgaaggtatcatggaagtagcaactgcaagaagtagccaccactccgtgggctaggggagcaaaaggaggaggtgggaaatattcaaacgtagagggtcctgagacccaaacctcttgaggagcaggtgctactcttctggtgccagtgtcaaggagcaccatgaggctggttctacaagtgctgaaattgcaagctagactcaacagctgctacaggagctgctgcagctggggtcaatgttgctggggtaaagctcatagaaatgggaagaaatggagacagacaagaaggaggaagtccctgcttcccccctccagccccgcggtctccctctaacgccccctatcggcatagcctaccaaggagtcacagagaaagcaggaatttggtttgcagagtcccagccccagtgggacaaagctgagcacagaaggataggtttggagcccgccctacactgaagtggaggggattggacagaggcacgaatacaaggatttggggcagattgggagccattttagaggctgcctgctacagttgcctttctcactatgaccctggcgatagttgcattgatttttttaagagtagtagatagccattctgcacgaatgacaaactatgaagactcaattcatgctgagtctcctgttctaaccaaattacactttataacaaagttaatttaaggcacatataatgatacacataagtattatggcaccatatggtaattaggcatccgtgtggtggaaagctcacagaaatgactgtaattagtattacttctatgcagccaaacccatttaactttttatagtcccatttgtttgggtcgccagtacgtatcaacagcctccacgctgatagttttctccagtaccacctaccatttaattatcaccccacatgcaaactctgacactcacataaactaaattacaaagatccaaactagtatcatgcaatcgttgggtgctctgcctctgcatccttctttccagtgttttccatttctccctattccccaaatgaaaactgagcaggaggaggcttgaggtagtaacaattggatcaggaggctgtgacctgaatttcttaagaaagatgctgatatattaaaagacctagtgagaacagcttaaactattctcatttcagaatggtgtacttgaattattaaagcaggcagcccatagatctcccctcacaagttgcagattgcttgggggtaattttagtagggaataaagtctttcaactttcaacaacaacaaaaaagttggctgggcgcagtggctcacgcctgtaattccagtactgtgtgaggctgaggtgggtggatcacgatgtcaggagatcgagaccatcctggccaacatggtgaaaccccatctctactaaaaatacaaaaattagcttgggtgtggtggcgcatgtctgtaaccccagctactcgggagcctgagtcacgagaattgcttgaatccaggaggcggaggttgcagtgagccgagatcacaccactgcactccagcccagcgacagagcgagagtccgtctcaaaaaaaaaaaaagtaaatatgcaaatcgaggcaagagaacatattagtatttaatgagctccaattctttggaaactgttgttagatcctttcttgtattgatgaggaagaatgagggccagaagagggggaaaggggaaaggaaatcaccaggggcagggatgggatgggacatattggggaactgtgaactagagacctacaaggtagggttgccagataaaatacaggatatccagttaaatttgaatgaccagatttagcaaataaaaaatatgggactcagttaaatttgaattttagatacacagtgaaaaatattttagcataaatatatcccatacaatacttgggacatacttattctaaacattattgttgtgtatctgcaatgcaaattaatcgagagtccagtatttttatgtgctaaagctggcaacattactacaaggttaacttctcactttcatcctggaacttgttttgtcattatctttgagggtcatggtgctatggggccaaagggacttcatgcccttttggatagccatgggtctgacattcatcctgccctcccctgctgctctctgcctcctgcctctggtccctcaggcctcaaagcccctatgccagcagacacagggcagcatgttgagggagaagattctgcacactcatttgaggcccgcctgaccctgtctccctcacatgttcaatagcactcggccccaccctcaccttctggaatgttgtgcctccaagtctctaagcaccacaatgtgtgtgtaaatctagcaaaatagacagattttgagactaaatggggactctgggtatggatttacacatgggcaaaatttttcttgctgagcagtttgtgttaaatgggatttagtttgctccttgatgatcagtctgggagggtagttggaaatctacccctgtacaggcttcttctgaagttgctctttcagattttacagcatcatggatccttttttagtggccaagttttggagctagcaaagcagataaagctacacggaatattcacattttcattgtggaaggagaaaacaaaatctgtgtctccaagatttctaaaaaaacagaaaaaaaaatgggttccattcaatgctaatctcttcttcttcttttctctttatccttctatctaattgcagtatgggtgaaactattgcccactactgggagaaggctattttctttgccagttgtccaaacaatggaaatttcctgcattctttgctgtagtttctcaaagttaatgggcatatgctgacttttaaaaaactagctgttactaggagtgaaaagagttacaagagaaaaaattgcttaccttcagactctccagtgttggcaaaaaattctttctaaagaaatgaataccaatgacaaaaatgtccatgctgttcttcataaatttggaccctggttctcatactgtgacttaccagatcccagatgtaatgccaggacagggaggataaaaggagaaaggcaggatctaattattagaggttcaatgttgtaccaaatggttcctgctacaaggctaacctcatcctccattcttcctccttttccctctgctctgacaacctgagctgttcattgccctctgagtactgcagctgtttctcccctctgtgctcatacctttgctgccctcccgccttttttttttttttttttcttgagacggattctcactctgttgcccagactggagtgcagtggcaagtgctgggattacaggtgtgagccagagcacctggccccttgctgccccatctgtccagctattcccatttcatttagctgactacttcctatcctttaacgttcaacatgggaaatgtctcgtccaggcaatgctccatcctggcccttccaagttgagtaatgtgtccttccaatgtgtcctccatagaggttgctatgtgttcccatagcaacctctgccaagctccatcattgtgtgaaccacagtataagtacttgttggtttggtctccgtctcctctgcctggttcacatcaggcaggtgggtgctcagtggatagctgaggtacaatgactttgaaatcctcgataatatattctaacatgctggctggaggacctcaacttaattaagcccatctgaggcttgtgacaatagtaacatgggcctgtgcactattttcaagattttcaaatgcccactggatatcacacatttacctggggtaagaaactttcttgtcaaaaataccctcttgcattatttctgagtggggttacattaaccctctctgatgaccccattttttttttcatgaagaacagtagatgtaattggccgctagtatatacttgtcctttaaaaaaaaagtccaaatgatcacttaaatgcaattttggggggaatggggaacagtaagtaaaatcaccactaggttgcacataaataaatgttttctttggtggtgaaaaggtgagatgccaactttgtgtcattattcattacttactcaaatttactgaacacctgttacataccaggcatggctttaggagctccagaaatgtatgtgctccacatatgttattgcatagtgagtaatcctctgcccaccattcttcttgtgtaaggtcggcgcagttcctgccagtgtggatcacagggccccagctggggagaacagagagaggcaactgatttccttgcagagtctggcattgagagagggttcagggcctcagggactgggtgagtgagcatcatgcctcagccacccctttcaaggcttcatgtttgggctgcttattttctgtgcttatgggaatctgagaacagacttggttgaattcattcttaccactcagctgcacagtaatttctgggcaaaaggaagcttctaattaagagttcaaatcccccagaagccatatgccaagccacatatgtgacaaaatccctggctgccttctctggtatagggacgataacagctaactggcgtgctgctctgggccagctgggcctttaacaaaacaacaatcacaacaactacaaaaatctgctgcagctgctggtttaagggatgggttattcaagggcccatctcccaccagctgctttgcatcttctcttttgttaggacctgagatatttaaggtcattgaagattctgggcctactttatatcaaatatctaaaattctgctcacattccacattaggtatggtatattttgctcttgctctaaaacatttgaaagagttttgtttcagttagctaatgctgtgtaacaaatgacttcaaaacatagtggcttaaagcaacaatgtattctatttcatggtgtggtcttcttcagcttcaagtggtattagctgggaacagtgggtgactgcagtcatcccaagttttgatcaacagctcagctgaggttgaaatgtctgaaataccagggctttaggagtcagatggagcttgactgggatttcagctgcgggccttgattcttctccatatgggcctccccatgtggctgcctgggccacctcacagcatggtggctgatgtccaacaagaactgttccaagagcaagcattctaagagggaggaagcagaagctgccaggtcaattaaggactagtcctggaattggcatagtaccacttcctctatattagtcaagggagtggcaagcccagcccacagtcaatgtgggagggaactatacaaggacatgaatactggggaacgtgttcatctggatcatcaaaataacagtctatggcaagtttttattattttggtacttaaaaaaacccccagaattaccatatgccccagcagttccacttctgggtgcatacccaaaaaaactgaaagcagggacgtgaacagatatttgtatacccatgttcatagcagcattttcacaatagccaaaaggtggaaacaacccaaatgtccattgccggatgaatggataaagaaaatgtggtattgtcttagcccattcaggctgctgtaacagaataccatagactgggtggtttataaacaacagacatttgtttcccacagtctagaggctgggaagtccaatatcaaggcaccagcagattcagtgactggtgagatccctctttatagagagccatcttttctcagtgtcctcacatggtcgaaggggtaagcaatctctctggtgtctcttatattaatatgagggtcctaatcccattcatggcccttacgatccaataactgcccaaaggccccaccttctaataccatcaccttaggggtgaggatttcaacatagggatttagggatttgtgagggaggcaagcattcagaccatagcaggcacatacatacaatggaatattggtcagcctttaaaaggaatccagtttggacacatgctacaacatgagtgacccttgaagatattatgttaagtaaaataagccaggcacaaaaggacaaatattgcatgattctacttatatgaggcacctagaggagtcaaattcatagagacagagagtggaatagtggttgttgctaggggctggggagagaaggaaatagggaattattgtttaatgggcacagagtttcattttgaagagatggaaaagttctggagatgaatagtgatgatggttgcacaacagtgtgaatgtgtttaatgccactgaactatatgctcaaaattgggtaaaatggtaaattttatgcatatttttatcaccataaaatttttattttgaattttataaaaataaaatgttcattttattttatttattttgagatggagtctctctctgtcacccaggctggagtgcagtggtgcaatcttggctcactgcaacctctgcctcctgggttcatgccattctcctgtctcagcctcctgagtagctgggactacagatgcctgccaccatgcccggctaatttttgtatttttagtagagacagggttttgccacattggccaggctagtctcgaactcctgacttcaaatgatccacccgtctcggcctcccaaagtgctgggattacaggcgtgagccactgagcctggccattcattttattttcttgttgtttttttaaaaattatatttataactatggaagagttcagttgagctgcaattaactatttctttgctattcaaagtcaagggactagaagcattggcattacctgggagcttgttagaaatgtagactctcaggcctcaccccagatctactaaatcataatctgtagtcggacaagatccccaggtgtttcgtatgcttattaatgtttaagaaatgctgaattacttgatataatccttgttttgtaaacatttattgattttaattatgtaattttctgttttgcattttggagtcatcatacatttttcaaggcctcagaaaattgtataggattttgagacgctctcaggccctagaccccatgtctagaatgccctggagatgaatctggtaaattttacacatagtcacatcccttttgtctctgatttctgactttctcttccatagttacagttcttcagatcatctatctggtttttacatgagttcttctctgagatgctgctaagatggctctctaggctttcagaaccacagcccatggaaaagggagccccaccctcaatgcagacccaggtttctctctaggataccacatcccaggcccatataaccttattgctgcaattactaaattattaaaatcaaccgtaaagcttcctactgaagaaaacttcctagttcatttttttctttaactatttactgaagcataatatacatgcagaaaagtgcaaaaataagcttacaaccaatacattttaatacattagcactctgttataaccaaccttcaaatcaaggaatagaatattaacagtacccaggaaaccctctgtgtcactactaccccatctcctgcaaattaaccactatttgaactaatagcatagattacttttaaccagtttttttctttatataaacacaatgccataatatatcctcttttgtgtctaacttcttttgttcgactttacatttatgaggctcatccatattgttgtaattgtagtttgtattcttattgttgtatagtgttccattgcatgaatttactacaatttaaattcattatattattgatgggtattagggcaatttccagtttggggctattacaaatagtgcagctaggtacatcttaatacttttgtcagggaaacacatgccacatttctgtgggaattaggagtgagattgctgggtcatagcgtgtgtctatgtttagctttagtgatactgtcaagcagttttccaaactgtaagccccattcttaatgtaaaagtgaatgctcctgcccctgttctatcccttcctaagagttgtgacaaatctcaaacaggacattactttcacataggtttatgaatttctgccaaaacattggtgctcacatttcaaaataaataaatgcatccatgaaatcctcaccagcggcagactgagaaagcaaagaatccagatgacagccataatgctgagatgctaagatggttttctttgttgcctagagcgctgggagtcttttgcaaaagctgctgccaatcaggcttgcctatctttgcagggctaattaacagcacttgggcaagcaagggggcggacgcctgcacgatgatgcgaatggtgccatcccaaggcttatgactaattataaacacaaagcacttaagggccgagattaataatgaaaaaaaaaaaaagccgaaacaaaaagctgaaaaacctcttcagaattctaatgccagcatggttgtggttgcgtgactcagggcaggggtgctggcaaaaatctccggactaaatcacacagcgcctatgtcatgcagccagcctcccagtcatgtgctacagaagggcttcctttgtgtcatgcaggatttcaggggagtgtgtcagctccatttccagggtgccctgggccctagcatgataaatctgttattcccttgccctccctcagcatggaagagcagactggggtaattcaggcccctacaggagtgggtagggtggggttgtgtgtgcaagctctgatccccttagctacaaaccacaaataatccataaagtatgcaaattagctcccaattaatagcacttactaacatcttgaactgtgtaaggagaagctgtgtttgccagagaggaaagcaacactcatgcacctcattgcaaaacacgtctggtcaggcggaaaaccctggacttgctgggagggagggaagaatgaagttgaaactgaaaggctgctttggtgccctcaggtcatctggaaaagtgtccacacagttcaggcttgaggagtaatttgatgtgagatgaggattcagatgagaatgagtttccctgcttcccctttccttggggctctgcttggtccaggccctaatgagttctgaatgttcaactacaggtcctcccaccagcctctgagaagagaacaggacaacccaatacccccagaaaactggaagtaagggtcaagggttgaggtgagggtggtgggggaagggaggagaaaacaaactattacttttaaaaagtggtgaaaaattgtttgccattatctgttgtttttttcctttttaatactagccattctgactggtgtgagatggtatctcattgtcattttgatttgcagtctctctgatgatgacttatgttgagcattttttaacatttgttggccacttgtatgtcctcttttgagaagtgttggttcatgtcttttgcctactttttgatgtttttttttcttgttggtttgtttaaattccttatatattctgggtattagtccttcgttagatgcatagtttacaaatattttctcccattctgttggtgtctgtttactctgctgatagtttcttttgctgtgtggaagctctttagtttaatcaggtctcacttgtcaatttttgtttttgtttcatttgcttttaaggtcatcataattttttttgcctaagccaatgtctggaagaatatttcctagattttctcctagaatttttgtagtttgaggttttacatttaagtctttaatctattttgaattaatttttgtatatggtaaatggtccagtttcattcttctgcgtatggttagccggttttcccagcaccatttattgaatagggtgtccttcctcattgcttagttttgttgactttgttgaatacgagtttgttgtaagtgtgcagctttatttcaggggtctctattctcttccattggtctatgtgtctatttttgtagcagtaccatgctgttttgcttactgtggccttgtatatcatttgaagttgggtaatgtggtgcttctggctttggtttttttttttttttttttttgcttaggattgctttggactctatatgaattttagaatagtttttttctaattctgtgaaaaatgacattggtagtttgacaggaacagcattaaatcttgcagattgctttgggcaatattggcattttaataatactgattcttccaacccatgaccataggatgcttttccatttgtttccatttgtgtaatctataatttcttttagcagtgttttgtagtcctcctcatagagatctttcacctccttagttagatgtattcctagatattttattttattttatttttgtgtgtggctattgtaaatggaattgcattcttgctttggttctcagcttgagtgttattaatgtatagaaatgctactgatttttgcacattgattttgtatcctgagactttgctgaagtcatttatcaggtctaggagctttttggcagactatggggttttctaggtatcaaatcatactgtcagtgaagagaaatgactttctatttttctatttggatgccttttatttctttctcttgcctgattgctctggctaggacttctagtactataatatgtttaatagaagttgtgagagtgggcattcttgtcttgttccagttcttaaagggaatgcttccagcttttgcccattcagtataatgttggctgtgaggttgtcatagatagttcttattattttgaggtatgttcctttgatgtctaggttgttgagggttttttaacatgaagggatattggattttatcaaatgctttttcagaatctattaatacaatagtatgttttgtgtttttaaatctgtttatgtggttaatcacattgatttgcatatgttgaaccaacctggcatcccaggaataaagcccacttgatcatggtaagttaactttttgatgtgctgctgtatttagtttgctagtattttgttaaggatttttgtgtctttgttcatcaggaatattggactgtagttttcttttttgttgttgttgtgtctttgtcagattttggtatcaggatgatactggtttcatagaatgagttagggaggagtccctcctcaattttttgagaatagattcagtaggactggtaccaggtcttcattgtatgtctggtaaaatttggctattagtccatctgctccagggcttttttggttggtaggcatttttataacggattcaattttgttactcttcattagtctatttagaatttctgtttcttcctggtttgatctttggaggttgtgtttccaggaatttatccatttcctgtggattatctgtgcatatagagatgttcataatagtctctgaagatcttttgtatttctgtgggattggttgtgatgtcatctttattatttctgattgtgtttattggatcttctctcttttttctttgttaatctagctggatcactaaatctctactaaaactataaaaattagctgggcatggtggtgggtgcctgtaatcccagctactcgggaggctgaggtggaaaatcacctgaacctactaggtggaggccgcagtgagccgagatcatgccattgcactccagcctgggcgactagagtgaaactgtctcaaaaaaaaaaaaaaaaaaaaaattgaattgagatgccaagattcattcattcatccatttatctattatgaatttactgagcacagaagcaccatgttaggggtgaaaccatctgtaatgattctgtggttcgctgatggcagatagttgtccaccaaggatttgttctctccttccatatagtagagtggtttctggtaggttgctgccaagtcagggaccacatgtgcctcccccttgtatcttgtaaagtggggtatgatattgtgagtcctcatcaatacaatgtgagcagaagtgaagtgtcctggccaagactttaaaaaaaaaaagtgttttagagcagttttagagtcaggcaaaattgagagggaggtacggagatttcccatatacaccatgctcctccatacacagcctcctctgctatcaacatccaccaccagaagggtaaatttgttacaactgatgaacccacaataacaattgttatcacccaaagtccacagtttacattaggattcactattggtgttgtacattctatgggttttgacaaatgtgtaatgacattatctgtcattatcatatcatacagagtagtttaacaaccctaaaattcctctgtacatcacctattcatccttccctccccctagcccctaggaaccactgatccttttactgtcttcatagttttgacttttccagaatgttacaaatttggaatcatatgatatgcagccttttcagattgggtttctttcacttaactatgctttttagtttcctccatgtttcttcatagcttgatagctcatttcttttttgctctcagtaatagtctattgtctggatgtatcaccatttatttatccattcatttactgtattagtacattctcatgctgctgataaagacatacctgagactgggaagaaaaagaggtttaatggacttacagttcacatggctggggaggcctcccaatcatggtggaaggcaaggaggagcaagtcacatcttacatagatgacgagcaggtaaagagagagcttgtgcagggaaactcctgttttcaaatccatcagatctcgtgagactcattcactatcctgagaacagtgcaagaaagacccacccccataattcagtcaccttccactgggttcctcccacaacatgtaggaattgtgggagttacaattcaagatgagatttaggtgaggacacagccgaactatatcatcccccccttagctcctcccaaatctcatgtccttatatttcaaaaccaatcatgccttcctaacagttccccaaagctttaagtcatttcagcattaattcaaaagtccacagttcatcatctcatctgagacaaggcaagtcccttccacctatgagcttgtaaaatcaaaagcaagttagttacttcctagatataatgggggtagcggcattgggtaaatacagtcattccaaataggagaaattggccaaaacaaaggggctacaggccccatgcaagtccaaaatccattggggcagtcaaatcttaaagctccaaaatgatctcctttgactccatgtctcatatccaggtcacactgatgtaagaggtaggttcccatggtcttgggcagctccacccctgtggctttgcagggtacagcctcccttccagctgctttcatgggctggtgttgagtgtctgcggctattccaggtgcatggtgcaagctgtcagtggatctaccatctagggcctggaggacagtggccctcctctcacagctccactaggcagtgccccaatagggactccgtgtgggggctccaaccccacatttcccttccacactgctttagcagaggttctccatgagagccctacccctgcagcaaacttctgcctggacattcaggtgtttccatacatcctctgaaatctaggcagagattcccaaacctcaattcttgacttttgtgcactcataggctcaacaccatgtggaagttgccaaggcttgaggcttgcaccctctgaagccacggccctgagctctacattggcccctttcagccatagctggagtggctgggacgcagtgatccaagtccctagactgcacacagcacgtggaccctgggcctggcccacagaaccactttttcctcctaggcctctgggcctgtgatgggaggggctgctgtgaagacctctgacatgccctacagacattttacccattgtcttggggattaacatttagctcctcgttacttatgcaaatttctgcagctggcttgaatttctcctcagaaaatgggattttcttttctatcatattatcaggctgcaaattttccgaacttgtatgctctgcttcccttataaaacttaatgcctttaacagcacccaagtcacctcttgaatgctttgctgcttaacaatttcttccaccagataccctaaatcatctctctcaagttcagagttccacaaatctctagggcaggggaaaaatgcatcagtctttttgctaaaacaacaagagtcaccttagctccagttcccaagtttctctttccatcttagaccatctcaaccaatactttattgtccatatcgctatcagcatttttgtgaatgccattcaacaagtctctaggaggttccaagctttcccacattttcctgtcttcttctgagccctccaaactgttccaacccctgcctgttacccagttccaaagttgcttccacattttcaggtatctacagcagtgccccactctactgttaccaatttactgtattggtctgttttcatgctgctgataaaggcatacctgagactgaaaagaaaaagaggtttaatggacttacagttccacatggctggggaggcttcacaatcatggcagaaggcaaggaggagcaagtcacatcttacatggatggcaggcaggcaaagagagatcttttgcagggaaactcccatttttaaaaccatcacatctcatgagactctttcactatcacaagaacagtgtaggaaagacccactcccataattcaatcacctcccaccaggttccccccatgacacatgggaattgtggcagttacaattcaagatgagatttgggtgaggacacagagccaaaccatatcacatactgaaagacatcttggttgcttccaggttttagcaattatgagtaaaactctataaacatccatgtgcagggttttgcaggaatgtaagtttcaactcttttgggtaaataccaaggagtgcaattgccggatcttattgtaagagtatgtttagttttgtcttccaaagtagctgtgtttattttgcattcctaccacaatcaatgagagttcctgttgttccacatcttcaccagtagttggtgttgtcagtgttctggattttgctcaaataggtatgtagcagtatttcatttttcttttaatttgtgtttctctgatgacatataatatggagcatcttttcatatgcttaatttgtcattagtatatcttctttggtgaagtgtctgctgaggtctttggttcattttttaattgaattattttttatttttattttttaggcagagcctcactttgtcacccaggctggagtgcagtggtattatcttggctcactgcaacctgtgcctcctgggcttaagtgatcctcccacctcagcctccagagtagctgggactataggtgtgtaccaccatacccggctaatgtttgtattttttgtagagacaaagggttttgtcatgttttatcaggttgcccaggctggtcttgaactcttgaactcaagcaatctgcctgccttagcctcccaaagtgctgttattacaggcttgagccaccatgcctggctgatttaaaaaaaaagtcattgaattttctaattccttgaatagtttagatgacagtcctttatcagatacatcttttgcagatttttttccagtctgtgggagaaaatatatctttcttctcaagcctgtggcttgatttctatttctcttgacaatgtctttcacagagcagaaacatttaattttactgaatactagtttgttctttcttttgtgtgtcgtgcctttgatgttgtatctaaaaagtcattgccatacccaaggtcatctaagtgttctcctatatcatctgtccactttttctagcaccatttgttgaaaatagtatttttgctcaattatatttcctttgctcctctgtcaaagatcaattgactatatctatatgagtctttctgggctctctattctgttccattgatttatatgtctattctttcaccaataccacactgtcttgattactgtagctttatagtaagtcttaaagttggatattgtcagtcctctgatgttgttcttctccttcattattgtattgatgattctgggtcttttgcttctccatataaactttctaatcagtttgtctacatctataaaataacttgctggggttttgacagggcttggattgaatctatagatcaatttgggaagaattgacatcttgacaatatcgagtcttcctatccgtgatcatggaatatctctccatttatttagtttttctttgatttcttttatcagagttatgtagtttttctcatttatatcttctacataccgatatccccaacttatgatggtttgacctacaatttttcaactttataatggtgagaaaatggtacacactcaacagaagccgtacttcaaattttgaattttgatctttccttggattagtgatatgacattctgtttcagtgctccacagtgcagtggcttgcagtcagccacatgatcaccagggtgaacaactgatacaatcattctgcttttcactttcagtatggtagtcaataaattacatgagatatttaacactttattataaaatagggtttgtattagataattttgcccaactataggctagtgtaagtattctgagcacatttagggtaggctaggctaagctatgatgtttggtaggttagattaaatgcactttcaacttacgatattttcaacttaggttggagttgtcagaacataaactcattctaagtcaagaagcatctgtactttgtaagatttataactaagtgcttcattttctggaaagctaatgtaaatgttattgtgttttagttttaaattttgcttgttcattgctggtgtacaggaaaatgattgactttggtatattaactttgtctcttgcaaaccttgctataatcacttaatatttccaggagttttttaagattctttcagattttctacatagatgattatgtcatctgtgaacaaagacagttttaattttttcttcctaataagtatacctttccttattgcattagctaatatttccagtacaatgttgaaaagaagttgtaagagggaacatccttgattgtttctgttcttagcaggaaagcttggagtttcttaccattaagtataatgttaactgttttctatagatgttctttatcagtttgaggaaatttccctctattcttagtttgctgagagttttgttttttttaaatgatcaatgggtgttacattttgtcaagtgctttttctacagctattattatgatcatgtaatttttcttctttagcctcttgatatgatggtttacataatttgatatttgaatattgaaccagccttgcatacctgggatagatcccacttagttgtggtatataattctttttatacattgttggttcaatttgccaatattttgttgaggatttatgcatctatgttcatgaaggatattggtctgtagttttcttttcttcaaacacatttgtttggttttggtattagggtactggtggcctcatggaatgagttaggaagtatttcctctgcttctatcatctgaaagagaattggtgtgatttcttctttgaatgtttggtagaatttaccagtggacccacctgagcctgcttggtgctttctgttttagaatgttgttaattatctattccattttttttcatagatgtaggcctattcagactgttgatttcttcatgtgtgagttttggcacattgtgtctttcaaggaattggtccatttcatcaaggtgatcaaatttgtggacatatcattgctcataatattcttgtttttttttttctttttttttttttgaggcagggtctggctctgtcattgaggctggagtgcagtggtatgatcaaagctcaagcaatctttctacctcaccctcctgagtagctgggactacatgtgtgtgccgctatgtctggctaatttttaatttttttgtagagatggagtctcactaggttgcccaggctgttctccaactcctgggctcaagcaatcctctttccttggcctctcaaagtgctggcattacaggtgtgagccactatgcttgcccttgtattattcttttaatgtctgtaggttcttcagtaatattccctctttcatttatgatattagtaatttgtgtcctcttttttcttagcctggctagagaattattgatttcattgatgtattctaagaaccagcttttgtttttttttaattctctatcgatttcctgttttcaatttcattgatctctcttctaatttttgtcatttcttttcctttgtttactttggaattaatttgctctttttctagttttctgagaggaaacaaattttcatacattgtattagtcaaaatatttaaaactatctcctcagacatcttcttgacccatgtgttattcagaagtgtgttgttcaatctccaaatatgttgggatttttcagctatctttctgttattgatttccagtttaattccattgtggtctgagagtacacatcatatgatttttattcttttaaatttgttaagttgtgtttgatggccttgaatgcagtctactttgatgaatgttccatgcaagtttgagaacactgtgtattctgctgctgttgaataaaatagcttatagatgttcgttatatccagttgattgatggtgttacattcaattatgttcttactgatattctgcctgctagatctgtttatttatgatagaggggtgttgtagtctccaattatgatagtggattcatttatttctccttgtatatatatatttgcatctgatatattcatgcagtgttattaggtacatacacattaaggattgttatgttttcttgaagaattgacccatttatcattatgtgatgcttcttcttttttttttttgagactgagtcttgctctgtcacccaggctggagtgcagtggcactatctcggctcactgaaagctctccctcccaggttcacaccattctcctgcctcagcctccctcagcctcccgagtagctggaactacaggtgcccgccaccacgcccagctaattttttgtatttttagtagagatggggttttaccgtgttagccaggatggtctggatctcctgattttgtgatccgcctgtctcagactcccacagtgctgggattacaggcgtgagtcatcgtgcctggcctgtgtgatgcttctttttatctctgataacttctcttactctgaagagtattctgtatgaaattaatataagtatgcctactttttttggattagtgttagcatagtatagctttctccatcccttcacttttcatctacatgtgtctttatagttaaaatagatttcttgtacacaatgtatagttgggtttcttgtttttgatccatggttgcaattcttgtatattaattggtgtacttagacaactgaggtttacagtgattattattatagttggattcatatctaccatattaattactgttttctacttgttgccattgtcctttgttcctatttttgtcttctactctttttgtccctttttttcattttataggagtctactttctctcctttcttagtgtatctgttatactttttgttttagtggttgctctagagtttataatgtacatttacagctaatccaagtctacttttataaaatacaataccatttcatggatagtgggagtatcttataataataaaacaattccaattcctctttttgtttcttatgtcattgctgtcatttattttatttatacatgaacatacataaatgcacacacatgcacacaaatatacagcatacaatcaaatacatagttgctattattattctcaacaaactgttgtctgttagatcaattaataatttttttaaaaagattttattttacctacacttgttccttcttagatactcttcctttctttaagaagttccaagtttcctacctatgtaatttacttctctctgaagaacttcttttaacagttcttgcaaagcagatctaatggcaacagattctctcagcgtttttttgtctgagaaagtccttatttctccttcacgtttgaaggatagttttgcagggtgcagaattttaggttggtagtatttttctctcaacactttaaatattcctcttcactgtttttgtttgtttgtttgtttgtgtggtttctgggggaagccagatataattctcatctttgcttctgtatagggaagatttttttcccctttgtcctcattaaatatttatttttattttttattttctgcagtttgaatatgatatatctacatgtgagaggttttttgtttgtttttgtttgtttgttgttgttgttggtatttatcgtgcttgtagttctcttcctggattttcggtgtctgacattgattcggggataattctcagtcattattgcttcaaatatttctttggttcccttctctctttcttctcctctggtattcctattacacatattttatatattttgttgctgtctagtcatggattcttgccatgtccagtctactaatatgcccatcaaaggcattcttcatttctgttattgtgtttttgattttttcttataatttcgtctatctgcttatattgcccaacctttattgcatgctgtcttctttgtctattagaacacttagcatattaatcataattgttttaaattcctggcctgataattccaacatctctgccatgtctgattctggttctgattctttgtctcttcagactgtattttttgccttttagtatgccttgtaattttttcttgatagccagacatgatgtactaggaaaaaagaactatggtaaataggcctcaagtaacatggtggtgaggtgtgggtggaggggaagtgttctgtaccctgtgatttggtctcagtcttgtagtgagcctgtgcctctggactgtgaacttcacaagtgcttcttagatgccccctccccttacttgggacaggatggctagaatgggctgaggttgggcatttccattcccctaagttagttagattctgaaaaaactccagttgtttaggctctagtaaagtagtttctctttaacgcacgccttgttaagaacagcgtgtatttcttttttttttttaaagtttttttttatgtgtattcaagggcttttatttattcataactcatttatttccacgaagtagttgtggcaattcataagaaaatatactaaaaaatataaagctataaataaacaaaattcaggaccagagaaaatgtagcaccattagaagatcaagacaaggatgtaggcatagcctatacactttggtcatctttattaaaaaagaagccataaatttctttttttttttttttttttttagtatttattgatcattcttgggtgtttctcggagaggggtatttggcagggtcataggacaatagtggagggaaggtcagcagataaacatgtgaacaagggtctctggttttcctaggcagaggaccctgtggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtgcagaacaaaatggagtctcctatgtctacttctttctacacagacacagtaacaatctgatctctctttcttttccccacattttccccttttctattcgacaaaaccgccatcgtcatcatggcccgttcccaatgagctgtcgggtacacctcccagacggggtggcggccgggcagaggggctcctcacttcccagacggggcagccgggcagaagcgccccccacctccctcccggacggggcggctggccgggcgggggcaagaacagtgtgtatttcagaatggttccttttcccctctccttgttgaaaacatgaggagattacaaaaaaaaaattattgtgagaacctggttgagctcttactggtaaaacttgcaagagtgcggggcttcccctatgcaaggtccccttggagcttttaactcttagtgtccacactgagcctccagctgttcatcaattacagttcaggtgttcctatcctggcactggttcctgagattcctgcttgtggatttctactgcagcaagttatgcttcttatgttctcctttctgttgcttccattttaggggcagcagtttgccctgtgaccatgcttctctaagaagagttgttgatttttagtttattcagctttttacttgttaggatggagtgatgacttctaagctttttacaggaataactgttggttattacttttaataggaatcatggccatttacatactcatgaaccttcaggccacgacttttaagaagtggacattcctttttcactctttttcttctcctaccagttgaattttaaagaagtcagcctggttctcagagtgactacagagaatacatcattcctgtcccgcttccggtattaccaagatccattttggcttttacaggattaagtaataagctctcattgtgctaaaccattgagattttggggtttgtctgttacagcagctagtgtgttatgtgaactaatgtaacaggcattgcttggagatgctccctggggatctccatttctctactcatcatggatgttatggcagatattgcagactggctcactcgcctccattccaaactttttgtagtatgcaaggtaaattgtagaaaggcaaagatatttccatatttccccagacacccatttttagttcaggtttcacaggagacagattttgccaagcagatgtacttgtgtgaaatttgagaaacagcaatgaacatagtgaggtggaggttgtgctttcactattactactgtttcttctggcaataatgtttgtgaaattgaaagtagtaggaaacccacctacagtggtgtaagcaaatagaagcctatttttctcagatagcaagaagtttggatgtaggcaatcattggatttgtccatgagtttaccaatatcaggatcaatcaggatcagtatctgtgcagttttttcgaattttccttcatggctacaagaccattgttggagctgctttattcaaggcaaaacaaacaaaataaaaacaatagaaaaggaaaacagtaacatcaactatgtctgcctgttttatcagaagacaggttttcccagaagccctcaaaaccggcttacccaaggtctcactgtccaaatttgggcatgttaccacctgaaaattaggattctactggcaaggaaaaaggagggaaagttatgggagtgccataatgcatagaactcatagtctctgccctcaaggatctaatgatggcttgtagagcaaaacatatgcatggatatttgaataatagtataagagttaagaaaaaatataaggtaataataacataagtgatagagcagatattttagaggaagtggacactttagcgttcaaatgcagcctatctccattttaagtagggctgacatgaagggattctgtgttttagttggacctgcaggcagcttcttccttgctgcatggtgtcatgctgatgtcacctgccaaagcagaagagtgttctgagaaaatgtccaaatgaagtgccttctacagtgttgatgggcagggagtggtgaacttaacctcatcccaggtggataaaagggcaccataggaattgaggaaagattccaaacacaagtctagaagtttattttgtgagtagaatgtttctctgaatgctggaaacaataaagccaaccacttgcctgtaattagcctggaccccataagtcacccagacataataccaagctctaaaattgccttcagagtaaggggccagcaccctggagttacaggcacttgcttttttggcaccagatttattgacattaatgatcccaatcccatatggagttccctggactgtttagataatgaatttgccttatgacagcagtgctccttctaatgaggaatgagtattttctataagtttttattttaatgtggtggctcttgtgatattgatcactggatcatgtgctgttcaagctcagctttaattttctcgataacatggttcaccaatccattgggatgctggtttaaacaaggatggaattctacagaactgcctctcccatatccctagggccctcattgtgcctcaggtcgaattccaactgccagtatatgcatctcttgcctgagggcgttctttgaaattatgtgaggactttgtctgcccaccctgcaggctggaagtgtcagaagattaatgtcacccttcctctggaatagctctcaaccaaagattgatgggatttgatggctcctctagtgggagaatgctaaggcttgtattctccacttttcccagagtgtcttcctagcattaagctacagtagcccatgatggttgctggtttacgaatacacccttgattgaagatgcgccttccctgtttcactttcccctgctcctctgcactgatttccttgagcaggctcacatttcaagcaaggaacatcaatgttattaattgactgtgaaaaagaaaaagccctcacaaccccaagaagaccaaaagaaagaaatatggctatttccaagttttatgatgacagagggaaggttccgccagagagagtctgccagagggagaagtgcaaagggctgatgggtaacaagctatgaatggtattataataagtattaataattctgctcctttgccaccccaataacaactttcactcatatccttgtctaggagtctgcttcttagggacccaagttaattcatgaagattgctcagattttttcttcttgcagactgtgttttttttttgttttttgttttttgttttttgtttttactacaactatctcttctgtgatgaacatccaagtgtttcagaggaaacataacctaaaatgagccccagtatattagtcatgaagaaaggacatttggttggcttctctgattgacccaaagcagaaacatgcacaagggacaaaatcagaaaaatgaacatagcatgttgattccaagctctttctggagacctctaggcctggtaaactagtttataccatgtgatatccctggaccatgtctacaatatacacagatcacatggcctctttgtgtcctttacaaaggacactctaaagttgagacctcttcaaagcaggaagcagccacaggtctttcctggcttcctgactgtgaggcctctgagcccaggccaggccatcgcatcccctgtgacttgcacgtatacatcccgatggcctgaagtaactgaagatccacaaaagaagtaaaaacagccttaactgatgacattccaccattgtgatttgttcctgccccaccctaactgatcaatgtgctttgtagtctcccccacccttaagaaggtactttgtagtctcccccacccttaagaaggttctttgtaattctccccacccttgagaatgtactttgtgagatccacccctgcccaccagagaacaaccccctttgactgtaattttccattaccttcccaaatcctataaaacggccccacccctatctcccttcactgactctcttttcggactcagcccacctgcacccaggtgaaataaacagccatgttgctcacacaaagcctgtttggtggtctcttcacacggacgcgcatgaaactgaccccaaggggaataagatgacaacattctaaagagacaaagtcaagagagacatgtcctagtggaagcccaaacatttgtttaaacttttagctcatcacccctaaacactgtgacttgactcatttatatttgttctctttccttggtgtacacttgaagatggtgactttattggtttgcaagagttgccataacaaagtaccacaaactgggtgccttaaatgacagaaatttattgtctcccagttcaagagtaaggcgttaacaaggttggttccttctgatggctgtgagggaagatctcttccatgtctctctcctagcttctggaagtttgttggcaatctttggtgttccttggtttatagatgcatgacccagatctctgcctttatgttcccatggtgctctcccagtgtgtgtgtttatgtccaaatttcccctttgtataaggacaacagtcataatggattaggagcccaccctactccaatatgaccttgtcataacttactaattatgtctacaatgactctatttctaaataaggtcacattcgagatactggaggttaagatctcaaaatatgattttttggggacacaattcagtgaataacagtgacccaggcagggagtacagtataatggttaagaagtaggccttggagatcaaactgacttagttgaaattttaactgtactacttacttgctcaatgattttgagtaacctatttaatctttctgaattttagtttcctcatctgtacaatggagatgataatagctacctcagagaactgttgagagaattaaattcagtgatgattgtaaatgcagagtaagtgagaataaataacaattcttattactattcatagccccttgcccaccagtcctttgcactttcctgtctggcagagtctatcagagaagctctttgggtcagagctctcttttcatcatcaataaaacttggaaatggcagtgtttctcccccttgatcttcctggggttaccagaacttttccatttttagagtcaattgataacattgatgttcctcacacaattgtgtgggcctgctgggggaaagcagtgcaggcccagataggagagatggtctttataaatcaaaaaaacatactccattacctaaccttttgaattttccctagtacatcctgctagaaaagagaaaccagttctcaaattttagtgctgttctttggtcaactttaacctgaaagagattataaattttcattatttcatagtacctttattaacacaggtgaacactgtttttcataggcagtcttttactctatgatacacagaaatacccagaatttgctgaattggataaactggctgtctaaagacttgggcaaaactgatgatcagtagacttagagggtcagagagacagaaaattccttgaatattaggagtcaagacggagattcttaggcactcagaaaaattgtagaggggtagagatttagggggaaaaaaaggaaacatttgttaactatctactctaaacagaacacttggcaacgtacagtggctaatgcctgtagtcccagcactttgagaggccaaggcgggctgattgcttgagcccaggagtttgagaacagcttgggcaacatgaagagacataatctctacaaaaaatacaaaaattagctgagtgtggtggcacacacctgtagtcccagctacttgggagtctgaggtgggaggatcatttgagcctcaggggtggaggttgcagtgaacagagaatggagatcatgccactgcactccagcctgggtgacagagcaagactccatctcaaaaaacaaaacaaaacaaaacaaaaacaaacccaggaacacttagtgtttttttctttcttttttttttttaaccagttttgccactgtcttaattggctatcccctcccctgtctctcagagcctgggtttcctgcctctagggaaagccattcacatcttcatgaggagaatggaaagcaagtctcctggaatttccctgttttttggaatttttgcagaccaccttccattcacccatgatgacccactgctccttgcctctgcattcttagctcttgggacttcgtttgtctctttcagtttctgataaagggaccttcaccgccatttcctttgatgacccattttgggcatagttctttgacttaactgtcctttccctcagctgcaaggctggccccatccccagtgatcaccccgcttcctgttcctgctttaaataactatctgggattctcactggggggatcagtcagacatagctttacaaccatgcttatgtttagtcctcaaagatattgggcagtgtgctctagaaaggagtctatcactctacaaatgggaagatactctgggtttggagtcttttcacaaatgttttcatgttcaccagaacttctgaagttggcatgtacctttgtctagtgaggtcatgctgggccatctccatttgtttcttctctggacacgctttggatagatcctgcaagatggggaaggttatcaagttagaaagacaacaaggatatttgctcacaccaaacaactttattgaataaaccccttgttgtgcattcttcttcttaagatggttggattcagtggttttactgtagcagaattgctgtggaaaatggggtggcatatatatactggtgagatattaccaaaataatgctgtgtaacaaaccattccaagagtcaatggcttaaaacaatattttaaaaaatatttatgacttggcaggccaactacaacttagctgggctggcattctgttccagtctccaggctgcagattggattcgggcaagctctgtgtgttttaatctgaggcccaggccaaagaggaagcaactatctggagtaatcactctcatcgtaaataactagagtgcaaaagagcagcccagcaatacaaacatatttcaagcctctgttcatttcacatgatccagcccgaagtcaagaggtaggtatccacccttcgtgaagccatagcaagatggtggatgattccaccacaggagaatgatatatttggacatatatcttcaaataaaatttattttatttaatatgtatcttcaaatatgtatatgtatcttcaaatacatatagtattttatttatatgtatcttcaaataaatttatttatatttatccaaagtagccaaaataaatgtctatgtcattggaaacagaggaagtggggagaaggtacagtaagggaagagttagaatagcagctttacatcctcaggatgctaggtatctacaactctgtgtagctgtgttgctgtatgtgtctatgtgttggattaggaaatgcaaagaaggacataaaagttgtaaaactgctttagagttcattcattaacatctgaaaagacagacaatgctaaaagcgtgtaaaagaagtacaaggtacacagaatttttttttcattttgtttgcctaagcagtgtttttaaggaaaaagtaggcatcattagctaagatgttgcaaaaactcaactagaaatttcacttacagctgatcagtcttttgggtaattaacaaaatggggtaggaggagaaattaatggttgtgccaatatttgttggcaattttgatttatttttcagtagcccccaattgataaaattatcactattcaaaaaaaacttacaaatagtccccatcattgggaaaaaagaaaacctgagagtgtcagagaccctgagagtgtcagagacaactacaaaaagaagtgcttgggtttttaatttttgtttttgttttaaatatagcaacttcatgtggttcagtgctctgggatacttttcttctgtcagcatcccttctgcattcagactctgcttctgtttgtcataccaaccactctgattgtgtagttcacatgagcagcagcatagtcttgagaccctctgctatacaaccttcctcatttattgtctcaagccaagataaattacacactttagaacagggccttaactgtaaatacttaatgattttcactttcaaagcactgtgcaagcatatgtagcctcattttggggtgatgatttgcatccgtaatcttttatgacataatttctttgtttttaaaatactgtcataccctttattattaatcttaatacaaagctgaattgttttctataatagttttactgatatataattcacataaccataaaattcaccatttcgaagtatgccattcagtgttcttttttaggtatattcagagttgtgcaaccatcatcactatctaattttagaacatcgtaactccaaaaagaaaccccatatccattaggagtcactccccattccgcctcccccatcctatctctggccaaactatatagcctttggcaatcactcatctattttctgtctctatgcttttacctattctgaacacatcatataaatggaatcatgtaatacatggccttttgtggctgacttctttcatatagcattgtgtttttgagtttcatccatattgtaacatgcatcagtacctcattcttttttattgttaaattacattctgttgtatggatataccaaagtttggttattgattcatcagtagatgaatatttgggtacatgctatgaaacacgcatgtataagtttttacgtgaacatatttttccaattcttttgggtatgtttccaagagtgaaattgctagatcatgtgataactctatatttaacattaaaaaatctcccaaatgtttttctaaagtggatgcactattttacattccaccagaaatgtgtgaaggttccagtttctccacatccttgccaacacttgttattgcctgtcctttcaattttagaaatctctaaaatgtgaaatagtatttcattgcgattttgctttgcatttccttgatgactaatgatggcaaatatctttgcatgtctttataagtgatttgaatatataatttgaaaaagggcctattgaaatcatctacccacttaaaaatccattttgagttaattttttataaatggtgtgaggtaggtgtattagtccgttttcatactgctgataaagacatacctgagactggaaagaaaaagtcgttttaatggactgatagttccatgtggctggggaagtctcacaatcatggcaaaggcaaggagagcaagtcttgtcttacatggatgatagcaggcaaaaagagagagtgtgtgggccgggcatggtggctcatgcctgtaatcccagcactttggggggcctaggcgagtggatcacctgaggtcaggagttcaggaccagcctggccaacatggcaaaaccccgtctctactaaacatacaaaaaattagccgagtgtggtggtgggtgcctgtaatcccagctgctagggagactgaggcaggacaatcacttgaacctgggagatggggcttgcagtaagctgagattgcaccactgcattccatcctgggtgacaatatcgaaagtctgtctcaaaaaaaaaaaaaaaaaaaaaaaaaaaaaagagaaagcatgtgaagggaaactcctgtttttaaaactatcagatcttgtgagacttatttactatcatgataacaacatgggaaagaccctccctcatgattcagttatctcctactgggcccctcccacatcacgtgggaattatgggagctacaagatgagatttgtgtggggacacagagccaaaccacatcagtaggggtctgtctttattcttttgcatattgatatcctgtgtctcagcacaatttgttggaaagactgttgtttccccatcgaattgcgttggcacctgtgtcaaaaatcaattaatcataaatatgatggtttatttttagactctcagttccatttcaatgatctgtatgtttattcttatgccagtaccacaccattttgattactataattttatagctttgaaattgggaaatgtgagtcctcccacgctaagaatggaacttttacagggagcttccagataggtcaaatagtgacaattatctgaggatagaccttctggaggaaccccaaacctgttctgtaccctccagtgtctattaggctgctggttttcacacataatatgattgtgaggctattggttttcacagtaattgtggaaccagggagaagggaatgggaagagatcaagccacaatgcttttaattcttaccaaaattcagccattttttcgggaaattttccttgaatttttgcaagcttttggttaatttccagagttctgaaaaagttgattttgccagtttttgccagtgttctgattgctttatgaaggagtagatttttggaggtccttatccatcatcctggaagtgctacttttatgttatttttaaagagatccatgtgatagatgagagtaggggactagaaactatagggcacctacaattccaagttatcttgtcagtgttacatgtaatagataaatatgttgatacagggtgtacatgatgtcagaaactacttaggtgtttacacttagttgtacaacaaaagccaaagtcaatcaaataatcatttcttgagtagctgctatgatgggataagcactgtaccctagagaataacaaagatgagtaaaactgttatttaagattctctctgtagaaacaaacataaacctagcttgaacttgtgtaggcaaatgaaagacctttataggaagaattttggggtgccttatgtaatcaaagccaaggttggacaaccaatctttgggtagtatggcaataaggctttgagatggagcctcatatactagaaccagggctttgaaacctccagtactctctgccttcctctcgtctctattctctctctgaagcttcattccctgtcatcatggggcagcctcctccatctgacaggaatgatggcagtggcagatttcatcattgatcccaattcttcatccttccttggatccacatcctttgccatgtgactttgcagttcctcccactaaaggggtagaatgtattctccatccttgactttgggaacagtcaagtgacttgctttagccagttgaattaggtataagtgacagagttccattaagaactgtaacggttatgagattttatcctacttataaatattcagttagcatgccaccattttattgatgtaggcagaagacatgagattcctgtgacagaaacaaaggactttattactcatgacacagcaagcagcatgggcttcatgtttgcatcaattctccttgcctcccaccaaattgcattaggatgatgtggagggacctaggtggatgatgcatttgcagtaggtgtgtcaagctgaagaaccctgagcttagggaacccaaatcttttataatggacagtaagcctgtctgatctttgtcctagagggagacattatctttgttatacaacaataagcttgtctgccttttgctttagggggagacactatctttatcctccaagactgtaagtatatctgctccttgatctggaggttgacaatatctctatcttccagggccatttgctgtacaaagtttggaaaaaggtgcagtcaatgccttgctagcaggatgtacagaaacgtgagagacccatggagaactgtctaacaacaagttcaagtgtctaagcttagatcttgagatgcctcacatgcttccacttgctttctttctcttccacctgcctctatggaaaaaacattccatggctagcacatttatcccaggaggaggataaaagacatgtggaacagaacttcccatgtaagcctagccagaagcaactgattcttaaatgactcaaggaagcatgaactaaatgaatgcttctggtactaaagtcttgtggttgtttgttatgcagcagtatctactgatgcaatgaccattgatggcaactcagttttccattttgtgtcttccatcacccaagaaggactgtcacaagtagtttctggtctggtaaagacctctgattggctcatcactaattgtaaattaacaagttagcagccagctgtggtggcacacgcctgtaatcccagaattttgggaggccgaggcgggtggatcacctgaggtcaggagttcaagaccagcctggtcgacagggagaaaccctgtctctactaaaaaatacaagaaaaaaaattagccaggcatggtggcacacacgtgtaatcccagctacttgggaagctgaggcaggaaaattactagaactcgggaagcggaggtttcagtgagctgagatcacgccactgcactccagcctgggcagcagagtaagacttcgtctcaaaaaaaacaaaaacaaaaacaaaaacaaagaagttagcctggttgggcatggtggctcatatctgtaatcctagcactttgggaggcccactgggatcatttgaggccagaaatttgagacgagcctgggcaacgtagtgaaccctcatctctaccaaaaaaaaaaaaaaatttaatgtaaaaaaatcagtagcatatctatacaccaataatgttcaagccgagagccagccaaatcccatttaaaatgagaacgcagtcccacaatacaataaccacacacacgcaaaatacctaggaatacatctctaaccaaggaggtgtaagatctctacaagaagaactataaaaaatcgctgaaaaaaacagatgatgcaaacaagtagaaaagaattccatgctcattgattggaagaatcaatattgttaaaatggctatattgcccaaagcaatctataaaatttaatgctattcttatcaaactaccaatgtcatttttcacagaattagacaaaactattctaaaattaatatagaaccaaacaagatcctgaatagccaaagcaatcctaagcaaaaagaacaaagccagagacctcacattatctgatttcaaactataccataaggctatagtaaacaaaacagcatagtagtggtacaaaaacagacacatagaccaatggaacagaatatagaacccagaaataaagccacacacctatggccatctgatctttgacaaagttgacagaaataagcaatggggagagggctccctattcaataaatggtgctagggaaactggtcagcaatatgcaaaagaatgacactggaccctaccattcaccatatacaaaaattaactcaagatagattaaatatttaaatttaagacttcaaactataagaatcctagaagaaagcctaggaaacaccattgtggacatcaggcttgggtaagaacttatgactaagtcctcaaaagcaattgcaacaaaaacaaaaattgacaggtgggacctaaataaactaaagagcttctgcacagcaaaagtaactatcaacagagtaaatggacaacctacagaataggagaaaatatcagcaaactatgcatctgacagaggtctaatacccagactctataaggaacttaaccaatttaacaagcaaaaaaacaagtaatcccattaaaaagtgggcaaaagacatggacagttctccaaagaagtatgcaattggccaaaaaacatgaaaaaatgctcaacatcagtaatcattagacagatgcaaattaaaaccacaatgagataccatctcacaccagtcagaatggccattactaaaaagtcaaaaaacagatgctggcgaggctacagagaaaaggaaatgcttatactctgctggtgggaatgcaaattagttcagccactgtggaaagccatttgaagatttctcaaataacttcagacaggactaccatttgacccagcaattccattactgggtatatacccaaaggaaaattgatcattttaccaaaagacacatgcacttgtacgttcattgcagcactattcacaatagcaaaaacatggaatcagcctaggtgctcatcagtggtggactgggtaaagaaaatgtatacaccatagaatactatgcagtcagaaaaagaatgtaatcatgtcatttgcagcaacgtggatacagctagaggccattatcctaagcaattaaatgcaggaaaagaaaatcagataccacagattctcacttataagtggaagctaaacattgggcactcatggacataaagatggcaacaatagatactggaaactactagaaggcggaggagggggtaagtgctgaaaaactggtactatgcttgctacttgggggacgggatcattcatatcccaaacctcagccccacgcaataggcccttgtaacaaatctgcccctgtaccccagattctaaacaaaagttgaattataaaaatgaataaatgaataaataaatagaaaaaatattacctaggcatggtggggtatgcctgaagtcccagctactagagagagtgaggtgggaggattacttgacgccaggagtttgaggctgcagtgagctaagattgccccactgcactccagcctgggtgatacagcaagaccctgtctgttaaaacaaacaaacaaacaaacaaacaaacaaacaaacctcagcctgccacagttttcatggcagtaagccaataaaatgtgctaacgtagtcacgggaaaacatagtcaatactgtcatcactatcaccatgtaaatgagtaagggacaattcctagggaaggaaagaggtgctgggcatctagtacaggcattcatggtgtaggagagacaatgaggtcctattcgaatagagtgcagttgagttctagacatgttttacttatgctaatccaatcattcctgtgtatttgtgtgtgggggggtcggggggtggtatgaaaggcatgaatctgcggttgactcagcctcaattccaagtcatcacttcaaaggttaagtcatttgttacattaagtatgattccaggtatttttggaatatctattttatagtatataatggcgtacattatacaatatatttactcatgcttcttcctgtatagggttggatttcaaaatcatatatactgtactttatggaaaattctggaaatttttaagtgtaattggcttgtcccttttcatatcctcataagctccttctccagaaattagatgtttcttagaaaaggggagggggctgggcatggtggctcgtatctgtaatcccaactacactggaggttgagatgggaggattgcttgaggccaggagtttcagaccagcctgggcaacacaacgagatcccatctctgaaagaaaaaaaagaaaaaagaaagaaagatgaagggaaggaaggataaaaggagggaagaaaggaaggaaggaaggaaggaaagaaggaaaagaaagagggaggggaaagaacctgaataggcaaaaattgtttttatcatctcatagaatagatgcttgaagtagaaattaggtacagtttttgaaaaaataagtcatggttttttttttaatgcagttgaattggtagatggagatgcatgcctgtgactctagccttcctcatcagtctggtatgttattatagaaataaaatatcatggaggtacaaaggaatgctattagtaatgacaaaggataaattactgtatatggaacaacatggatgggccttacaaacacaatgttgaatgaaagaaacaagatttatgagagtatttattttatatttcatttatagtaagttcaaaaccatggaaaactaatcaataaagttagaaatcaggagtcacatgaggaaacaaagagagcttaggccctggcaggatgcctgagacgtagtcttgcctcctgggttcttcttcactagattgaggccctagggaagacaatgatggagccaccaaaacacaggggagtctgtgtgccgtgtcctggggacagtctggaaattcagcaagggtttggggattttctttcacagatcagaggaaatatctgagtagatgaatgttatatgctgccagtaaagcttctgtgcttcagaggtggagaggaggagcagaatattctggcacaggtaggagtggtgtggttatggttcagagttgatggtgttggagtgttcttgttgcctggacaagggtggcccagcagtgtcgtgcttggatcaataattaaaggttgtgtggaaatgaggctatctgaaccaatgccagtgtggagagaagatgagatctagagagggattctttcctgcacctctgtcaacccctttgccttggcatctttggcagcagatggggattctggaactctgggtgattcagtttctaccacttgaaagttctttcaaaaaataaggaagtatttttttgcagacttgaatttgtagcctgaaatttgttcctgtattccttaaatttgtataaaattagtgttacaacaattccattttattcataaaaatattttgtgggtattttccaaggtctttaatctgattttgtggtatatttcatcaaatgcgtgtgccataatttattttggctattcatgtgggacatagatgtagtttctaatttttattattaaccatgctgctgtgatacgtgtccttcacattaaactccctgtcatgcttttgctgtatcatcatcactcctgcactcatcatatcttattctcattttatctttgtcccagtggagaattcagttaaatttgttatttgtactatattatatatatattttaaaagattttatttgtaacagcaggtttaggttcacaccaatattgagcagaaggttcagagatttcccatttacttcttgctcccacacaggaatagcctctgccatcatcaacatcccacaccagagtggtacaattgttacagttcatgaacctataattgacacatcgttatcacctagagtccatcatttacattacagttcactcttgctgttgtaagttctatgggttttaacaaatgtataatgacgtatatgtaattgcagtatcatatacaatagttcagttctttttttaatgagtcatgcctttgtgttatatctaaaaagtcattgccaaacccaaggtccaaggtcatctaggtttttcctgttattttctaggagtttcatagttttgtgttttacatcttaggtctgtgattcattttgagttgatttttgtgaaagggtataaggtctgtgtgtagattcatttttgtgtgtgtgtgcatgtgggtgtccagttgctccagcaccatttgttgagaagactctttgactcttttctccattgtattgcctttgctcctttgacaaagatcagttgactatattcatgtaagcatcatatatgtttttaatgaggtgctcttcaatttttctggaataagataaaacataaattaagtaaaactaccataattacgaaacaaaagtcagaatgtttagtataacaaatgtgagttcacaagtgatgaaactgcctagacactttatggacacatgagatacagaaacttaaccaggtaaatcccaacactcaatgctactcatctgtaaaactggataataacaatacattctttataggattgttgagaggattaaataaactaattcatgtatagtgcttgaggcagtatttggcttcttttaaatgctccataaatattattattattatattatcatcattagtggcagtcaaaaataaccattttccgtagtggcacacaggaagcaatatggtggactagttaactgacaagagaatgctgctggtgaccacagaattttctggagaagccagctctttatttcctcctttcttcagggctttaaaagcttcttaaaaaagatatggacctagagcagtaatgcactggggcttaggatcccagtggaaccacacacttgaaaatggttggaacttcttgccatcgcttgcctctacttgtctctgtggccttgctctcttgctgtcttctgatgactggttttgtcttctacttaatctgcacaagcaatatggccaccgactggaccaaagttttatgtgtaggaggttcagtagcctggagagagacccatcccttttccaaagactaaagtcacattttcccaggggataagattaattaggttaaattgtgatggtgcttacctctgaattggcaacttggagctaagggaacaggataatattaaacaaaccactctcatggaaaccatgtggcttgaggaaatgggaaggcaagatccagagaagcagggacagtggtaggacaaacagtgtatagatgtccactgtggctggttctccctgccgtcgtcttcttcctcttctttttttttttttttttttttttttgagacagggtcttgctctattgcccaggctggagtgcaatggcgcagtctcagctcactgcaacctctgcctcctgggttcaagcgattctcccacctcagcctcttgaatagctggaactgcaggcacacaccaccacgcctggctaatttttgtattttagtagagacggagttttgccatgttgcccaggctggtctcaaactcctgagctcaagtgatccacctgcctcagcctctcaaagtgctatgatttacaggcatgagccacctcatccagcctccctgacatcttcttgtggcccttgagaaaggaaatggagcagacttctctgaacactcattcagggaagtgggaattgattactagcttggctagtacttcacctatgttatatataaagtttcggtgctgcaaaagaaatagcactccaatataaaattttgttttaattctcagcaaggccaggtaattctatagaagggtgcgcccttacagatggagcaatggtgagcacacacctggacaagggagggaaaggggttcttatccctgacgcacgtgacccttgctgctctgttgttcccctattggctagggttagaccgcacaggctaaactaattccgattggctaatttaaagagaatgacggggtaagtgctttggcaggaaaaaaatggttatgcagggtggagaatgagttaggtcagagcaggtagcaggtaatcggaatgagttagggtggaacaggtgatccgaatgagctagggtggagcaggtgatcggaatgagtcagggtggagtaggtaatcagaatgagtcagggtgaagtaggtaatcgaaaaaggttgctttatgaaagttaagtttaaaagtagaaggcaaagaattgaacatactaacatattaattctttgaagagaaatttagaattcatatttaacaacttcctccttttgcatttttcttacagctttctcttcaaacttatttaacatgtcttgagttagttgttctgcttgatattctaaaagaaaaagcttctctgggtaaggtggaggatagttaagggaggttttagtaagtgccatttttatgagcctctgcatctacttatggacgcatggtatgacacagctcctgacaagaataagttcacctattacggctacaagggaggtaagaattgaggggattattcctttccatttactgaaccacttctctagccatcctgtaaaggggtcatttacccttgagttgctggctaactcattggatagagcagtcagaccttgcaatgcctttgttatacttccattaggggcggtgttgtttgggatgaaggtgcaacattgagttttaatcatgacgcaaactcctcctttttctgctaatatcatgtctaaggctatcctattttcccaagccatctggctagcagtagcccctaattgctcagctattcttttaacagcatctttagtgtagttaataaatcgctgttggttgtaacagatgtagtttatccaatctagatttttattaattgtcacccaccaaaatattgactcaaatcctgcagctgtttgatttctggctttaaattgatctggtatcccccatgggactccaactgtgtctaaatagatgtgagagtcaaaagatccataaggggcttctctcgctttacgatgtcttatttttccttcttctggttgatgaaatgccagggtggaagggatagccaattggattaaagcacaagtgccactccagttattcggcagagtgtccagtaaaggtccaccacaataccaccacacagcctcttggggatgaacaagggctgactgattgctaagctcttgaaagttcttaagctcactgcatcccttaggtctccaaggaatgctaagtttcctccctgtcgtgagagacacaaagtgaacttagtgttgggagacggaagctggacggccctctggggctaacccgcagggtgccggacttcgggatatagcagagcgagagcttggcatgacttgttatcccaggctgtagaatcctggaaaagagctaccgtgcagcccatcctcagtcgaccagaggaccaccctagtggaaaagggacaatctgggcctctggcctgccacgagcacaagcaaaacaattgcttttgtttacatgcagatggcatatttgatctattccaacaaggcatttacatcttggtatcctgtctcaattgccaaagtttgttttaagtctttaacttctaccatcgctatcttggccttattgttagatggaggaggaacaatggttccgttgtaagaggttttggaaaaaggcttagaggcaggtgcaggtggcacgggatcaaaggaatgcatttcaaataatccaatagggtctgtccctgaaacctcagcccccataccataaaaccagcttgaagaaggtaactggcttagaaaaggggaagaattttgagggctcaaaataataacctgtataggattgcactggtttagctgacagttgtggggggctattcctttagtaaaatgaatgtatggtttcaggaaattacaaacactagttggggcagtccatcctcactcttcagtggtccacagaacactggaccaagtacggcataaaagctctacatcgggggcaagactcctggttgaccctggtctttatccaaatctccccagattaagtggtaccaattcactagtgcccagtttgaggagagccaggagggacggaggtacttttctgaagtagagagctgtctttcacttgagaaatccccacagggtataaaaaggcaagcatcaaacacaatagtttgaggcaaaattgactaggttatgttaataactagatggtcagtgatagagcgcggaaagaagaaacagtaataaaatagatgaaagagagttaaattcttcttagctttagtttggtagggttttcccctgggactatggcccatgactctggagggggcggtgctttcttgacccggatatggtgagtccatcctttctctgctgtgcggactgtggtttcagtagttaggagcactaaataaggacattcccaggctggctcaagcttctcctctttccagctcttgatgaaggcgtaatccccaggctgatgttgatgcactgggaactccaagagcggtgcttgtgctaatagacctttagttttaagagaagagaaagtagaagatagaccaagtatacaatttttaaggaattgatcttttgtttcaaaggtaggaatatcagcaggggagtgcaaataaggtaatccatagtgcatctcataaggagaaagaccaatatctttccctagtgcagttcgaattctcagcagggcaataggaagacacttggtccatggcaatcgagtatctaatactaatttggttaagtggttctttagagtctgattcattctttctactctccctgatgagggtgggtgccagggcatatggtgttcccatctaatgtctaacgtttgggatagctttttcataatgtgtgtggtgaaatgagttccatggtctgagtcaatattttctattagtccaaacctggatactatattttcaattagggtcttaactacattatttgctgttgcatttgaaaaggagtagcttcgacccagtgagtgaggtggtctactatcactagtaaatattttagacgacctattagaggcatttctgtgtaatcaacctggatactttgggatggccttaagcctggattccttccctctagaggtaatctttttatagtatgtctattagttttcttacatactaagcaactatctgtaacgtgtttggccagggtataaattccaatacaatcataaactctgagaactgcgtcacacatggcctggggcccccagtgggtcccctgatgtagttgggagaagagttccctcataaggggtttaggtaacatttgtctctggtctagcagtatccactttccttctgaattctctttagtgcctatttttattagtttctctactaaatggggattatggtaggaggagggaggtagggagttaagtgaaaaatacacatttcagaagacacagcagcctgcttggctacctgatctgctaggttattttcttgactttcaatagaaaggcttttctggtgtccgggaacatggacaatagctattcttcctgcaactgaagattattcaatacttgggtgatcagctccttgtgaacaaagtcttgacctttactattaatgagacctcgttcagtccaaattttcccaaacgtatgggccactccaaaggcatacctgggatctgtatagatagttccttcctggttctgtaagtactttaaggcttggctgagtgcaaacagctcacacgtttgagcagaccaactgttggttggtcaattttcttgaccctatttctacgagactttctccatcaatcactgaatactcgttgtgtctttttccctcaatcacccgggaggaaccgtctatgaataagtgctgtccagtccagaagggggtttctcctaggtctggttgaaccttgtatgctaatcaattaaatctaaacatgtgtgttctctccttagatttgggttacctgttaggaaacctgctgggttgagtgaattatcagtggacaatgttaaatcatccttttctaacagaatggcctcattctttaagattcttgagtcagtaagccatctccttgctctttggattaagatagttctaacttggtgaggcatgcttactgtcaatttccctccaaaggttaactttctgtttcctcgactagtattgccgtagccgtgatggactggatgcgttgaggccatccacaagtgactgggtctaagacctttgataggaaggctacgggctgccggcggcctccgtgttcttgacttagcactcctaaagctacctcgctgtacacattaacaaaaaggtggaatggcttttctagggagggtaagactaaaacaggggcagttatgagcctttccttcagcctctcgacttggtcagcttcctcagaagtccacaggagacagttaggcttctcctgggcaagcttttgatataacagtttactgtgcagtgcatatgagtgaatctataagtggcggtatccaactaaccttaaaaatttcctgagttcttgtttagtttgaggtaagagtagggacacgattcccttgattcgttcaggccctattctttgcttcctgtgcttattaagtgacctaaatatttaacttcaggctgtacatactgaagctttctttttgagacttgtagcccctcaaactgcagatggttaagaatatgtgtagagaagtcagttaccttctctatgtcttcaccagatacaagaatgtcgtccatgtattgaagaaggcatatttgttctggaatgacaactttttctagtacttgttctaaaatttggccaaaaagattaggggagtctatgaacccttggagcaagactgtccatcgatattgttgtttctaccctgagtagggatcctcccactcaaaagtaaatatatctcagctatcttcagccaggagacatgcttgaaaagcatccttgaaatctattacggtaaaccattgatgattatatggaatcttgctaagaatagtgtaaggattggggacaacggggtgggtagtctggactatttggttgatagctctaaggtcctctactagccagtatgacatgtctgatttcttgaccggcagtattggggtattataaggggacatacagggcttgagaagcccatccttaataaggcctttgattataggtttcaaccctatcctaccttctaggggaaaagggtattgcttccttcatactacttctctcggggtttttagcttgagggataggaggaacttggagtttccctcggtttccttctttgaaccagacattagtattaatatatttttcatctgcagtggtgagtaggtttaatgaggtaaggaatcctcttgggctgacttgtacacctatgccgaactttaacattaaatccctccccagtaaattacttcctgcttcagagattaacaagaacagaatatgacctgagcaatcctggtatctaacttctgtgctttgtaaaatttttctctaaatccttccccttttaccctggagactaaaagttcctctgaggaggagacaacattacatggggggaaacaaacagaggagcgagcagcccctgaattgactaaaaaggtgataagctcatgtttggtcccacctccaaatttatcaagggctcctggtgggactcaagataaaagagacagagcccctgaccccccattcttcctcgaaagtcatgagtggaagggcttctttctcctttcttagttcaggacatcctctcttgaagtggcctattcttccacatctctagcccctatcttgtcctttctccttcttagttctgggattctttaaccttgctcccctatactctttagggggcctggtagacgaggacttttgtcctccagatggaggctgggtcctttaagagagggttcagaccctttatagtttctggctctctagaagctctgtctagaagtacctgggtttggagccatctgttggaaggtggaaaacataagttttgtcttttgtttctgttttccttcgtcccttttcatgtatactttctgagcttccctgagaagctcacttagaggatggtctatcttttgtaacttttttgaaatgtctggccaacttttagtgacaaattggagtttcaacattctttgcccaagggcatcatccacattgaggcttgcatattgcctcatttgctccctcagtctgtctaggaatctcataggcccttcatccttttcctattgtatatcaagtgctttagaaagatttcgggttcggggtactgattcccaaactccttttattatcatctcccttaggtcctgcatatattcccggtgatctgtgttgttattgtcccacctggggtctcaggcggggaatttctggtctgcataggaacgtttcaccgggagggtgctcatgttcccaaactaccatagcagccctacaaatcatattcctttcttcccctgaaaagaggatgcccaagatggacattaactcgacctaagtgtataactgaggtcctaagtattggttaatttggtctgccactctgtaagagtcatctagttgtggtttaaactcctttttaaaattctggacttctgaactggttaggggagcatttacaaagccaatgcctgcccccgccttgtggtacctctttcaaagggaagagcattggggctcacctgttaggtacagagggaaatgggaaattctgaatatcttttttatattgttctacctcacgctggagtccttttagagaggggtatttaagttgggagggaacaggctggtggggttgtaattcccaagagtcaggggtataaggagagggataacgtgagtagaggggcaatttggaatggaatctgaggcagcagtggctgtctgaggggaaagattggggattctgaacagaggaagatagtctaggggatcccatgtgctggaatctttaggcatgagagctggctcctctgacttttcattttgaggtgccagattgggttcttccctatttgtttttaagggaaaaaggagggcaggtccttgtctccaacaaaggacataacctagttcttcttgagacactggacttttttcattaacatatcagattagaagctgacacattacatcctcattcgacccaaactttggcccgaagattgagggtttgaggatgggtccctgagtccaaataaaacaataatattttatcatttgttgctttttcctatgtttagtcctttcattatccttccagtgttttagcatgagacctaggggtctatccgaggggatatctttgttaccatctttatcccccttgctccctgtcttgcttggggtatttcccatcttgatggttttggggtaaggttcaaggttcaatttcccttactggaaatttctcaccttttggggtgaggctcagtttccccactggaaatttattgccttttctactactggaggtttgtgtgaggttcagttccccccagtagggatgtcttaccgctttttaacctctaagccaccctgaccaaggaatacttctccgcccctgccgcagctttcttatcttggtcctgatcaccaaggaaatattttacaggctctcgtggcttctccttccttggtctgtgcacagagtcgttgccacagtatgtgaggatcttttaagctaggttgctggccagttttttgttttttttgtttttttttttcattgctgagagctcgggttattcctggcactgggtgggttctgatttctccctgttgaggctgccacaaggggcggggcatgcaccagagagaaccagaggctgccctcagaggggaacataatcctgaatgagcccccaaattttggtgccacaaaagaaatagcactcgaatataaaattttcttttaattctcagcaaggccaggtacttctatagaagggtgggcccttacaggtggggcaatggtgagcacgcacctggacaagccagggaaaggggttctaatccctgaggcacgtggcccttgctgctgtgttgttcccctgttggctagggttagactgcacaggctaaactaattccgattggctaatttaaagagaatgatggggtgagccctttggcgggaaaaaaatggttatgcagagtggagaatgagttagggcagagcaggtagcaggtaatcagaatgagtcagggtggagcaggtggtcggaatgagtcagggtggagtaggtattgaaaaaggttgctttacaaggaagttaagtttaaaagtagaaggcaaagaattgaacatactgacatattaattctttgaagagaaatttagaattcatatttaacaacctagcttgtggacatgccttctcctgaactctctctgtttctctttacctgttcccatcgtccagcttgtaggcaaaggaagacttgctgaggcttccaagtgaaagatattggcacattttacaaagaccattggactatcacttgaaacactttgctcctttgctgtcctgagagcaagcacattggtgcttgcgggaagtgtcttggggagttaagcaccagctcacagagatggtgaggtgtatttcagaacccaagcttctgccagggagcatatagattttgttatttcaatattagcagcttactctccatgggttttattgcataaatttcaggagggagtgttttcttgactgacaccttagaagcactctttgtagcaaagtcacaaacatttccagatcttgctgggcatagagatggctgcaccactggaaacaatctattggtgtcacttgacacagtgtgagaggtcaggtaggggtgaacagcattgtctgcacaccaagtgggaacattatctgctctgtggggaggcccatcatgcttggcctgctcaggaggaagactgacacatgtgggtcattccgtggtgccttttctccttcacagtgaaaagaaggcctgacacttccagaggaaaatgacactgaaagcactcaggcagaggaggggaaaacatgaccatgctttctggaaaaccctttcttcatgcactcatgccaatcattgttttatccaacttagctaatccatttctaattttttgttccttaataaaagaaaaacaattcaactgtcacttactgaattctttttaaaaaaacttttattttaggttgagggttacacgtgcaggtttgttatataggtaaactgcatgtcacgggggtttggtgtacagattatttcatcacccaggtaataagcataatacccaatagtatgtgttatttatcgaattctcactgtgtgctaggaccagtagtgtgctgaagatggcttggacaggctcacgagaagcttaattgttcaatttgcaggaattttgcaagacagctgttaaacacagccattattaaaattcaattatattaccttacacttaaaaacaaaggcaataaattcaacttatcatattctaattattttactcttatttatgctcttgaagttattcgtgtctattgtgtctgtatgttggagctactgaatgataactagctactgtgtatctcctgtcacactggtggcttgaaattgttcatgttgggagtatttacaccacagaaatcagcaaatgctacaaattcaagtttggtttattgttttgttgattgtttagacttaaaaaatgatggagaaaatgtcagtaattaaaagtaatagcaaaaaccgcaataacttgcaccaacctaatatgaacagcacaaaaatttgagaaaatgttcttccagtatttaagactattacctgattcagcaaactaattatagttactcatgtcattgaccaatgagtgaagttctgatgtacatttttgtctcatttttatcttattaatacgaacaaaaatatcaaccaacatatctgtcacagctacactcatttgtcagttgcaaccatagattggctatggatacaagagttcagcaaaatcattgaaagcattttatgagaattcattggctaaatggaatttacaataataagtattatatatttcattatttttgtaaattgtgtacacattctattagtataatttatataaatatatatacatatgcacacattttgagagggagagcgaattgtaactattagctgttatttactctgccatgaatatacttccctatttatctcaccctccaagacccaattcagggacaaatctatcccttctttggggttctttgtcatagcccttgttcacaatgcattagggttctgtgaagttccttctccttcctagaacaaatacagttgaagggcaggggctttgaattactcagttctgaacatctggagctgagttccatgcttggtacataggaggtacccaaaggtgttggttaaaagaaacagtgagagtcttgaaggcagtgggtggggaagaaaaaaaagaaaaggaggaagtcacatacttagaaaaggcacaatggtcagtactatacatcatcttttaaaatttaaatcttcttaaggttcctaaaggtctgtataaaatacagcaagctttgatttccaataccacaacccataaaagcccttgatggagtagatttgtctgggggttccatgtgtttagaggaacaagacgagtcacctggtaatcatatcattcccagtatttgacatgtgtcttgggtgatgcacagtggccaatccttcctgtttcctttataacattcattgaataattccttgaatgtggcaggcactggattttccatgcatcatatgtgagggaagtgacagtggaacatcaaaagcccaggagaacttactctccttccagcccttgcatcctcctgtgtgccctggctgcaggctcctccccacatccttttggagggaactggataccagtcctctagtcgggaagtattttcagttttaaaacccagtcattattgactggctggctgagtttcctgttcaaaaagtgcacaatcacccatctccccaaaatatacgtccagccaaggatcagatttccctcagctggccagccacttttctaagatgagcagttgccaacaaacaagcttggaagcaagcaaacagttgtcttttctccctcactacctctctcccgtcagtcataaactccaagaaaggtcagctgggacctgtccagcctccagccacagcctagcacagggtagacatgtcaaacaaaacaggaaaaataatttaccttgcccttgtcctttccctcaagttttatttttatttgccattgacttgagagagcccacaataagaaaaagaaatcaagcctagatcattgtctcttccctggactgttgaactagactctgcttttgtcctggcctcctgcaaatctttttttttttttttttttgagcctcgctctttagctcaggctggagtgcagtggcgcgatctcagctcactgcaaccttccgcctcctgggttcaagcaattctcctgcaattctcctgcctcagcctcctgagtagctgggattacaggtgcataccatcatgcctggctaatttttgtatttttagtggagatggggtttcaccatattggtcaggctggtcttgaactcctgaccttgtgatctgcctgccttggcctcccaaagtgctaggattacaggtgtgagccactgcgcccggcctcaaatctattcttaattcagaggctagagggattctgttaaaaggtacatcagaaaatgccattcttttgctcagaactctccagtggctctcccttccaccagaggtaaagccaaagccttccaatggctaaaggctctacatgatcagctcctatccccccagccctttatatatctcatttcctactattcactccctccctcattcctcagcagacacaataatcttgttgttctttgaactcatcaggcacctctcgcctcaaggcctttcccctcattgtttatctgccaaagacactctccccccgatatccatgtggctcactcgctcacctccttcatatctgtgcaaacatcaccttctcagcgaggtccaccctggcatgtatggtactatgcagtgctgcaaactgccttcttcctctctattgctgttcctcgtcatcctgttctattatttccatagaatgcatcatcttctagcataacatataatttatatatttatcatatttatagtttgtccctcccaagtagaaatgtaagcagtaagaggacatagatttttgtcttttgtgcctattttgtctagaatagtgcatggcatataataggaagtcaataaatatttgtttaatgaagtatattccatttaagacaaagaatctgaggctgactctaagtcacaaacattattgaggcattttggagtagacatcagtttcctccatgctagaagccacattcatcagctaatccttgcttccctttcattgacagtgggactcaggggagaaagttccagggagttcactgcagagccaagtagatagatagcattggaattttcctgcatttactttttcatcaaggtcaagaagaccacgtgaaaactctaaaatgtggtttttcagttaaatacattgtcttgaaaatgcccttttgtttgcatgatactatattcatgtgtcaaaacttacagaataactctcaagcaaggaattggtggtggtggtggtggagacggggagagggaggtgcagttgaagagaaggaatttagaaacattggcttattcatgtgagctgctctattaataaagccagtgccccctttataacagggagccctgggaaaccaaatagaaaactcctgtttttaagagacagactaattgagtcatcgtctctgaattccctctctgctacttctcactcagactgctgatgattttatttttaatttatctaagggggctatgagtcattattgagattagtttccataaggtcctctatcactaaacactgtaacaacctgcagtagttatctattgcataataaattaccccaaacttatttggttaagacaacaaccgtttaatttgcctgcgattccatgggtcaggactttagaatccatttaatcagcttacaattctgtaggtcacaaattcagggcttggctgggtggtctttctgctccaggtgatgtcagctgggatcattcatttggctgcattcagctagtggctgtgctcagctctaagtttggcctcatgcacatctctgctgcttctgcgttcttgggttcctccatatggccttgctttctccagggacttgggctccctcacagcatggtggtcttaaggtgcagccatggaacttgcacagcagtaacatttctaccatatttgattggtcaaaactgggccaaagccagcctatattcaaggggaggggattctacctctcactgaaaggaggggcaaagacttgatgactgtatttaatccattacataatcaaatacaggcagtcagtctccactttcagttgtgctttatctcacctctctgcttaataaaagatgcaaataaaatatgtaaaaaaagttgtattcaaggaaccttgagcatataagtgcccaaaatatgcacctcactatttataaatgctcccactttagtcaagcattcactgtaggaatttctctgcctccaactctgtccctgaagaggtattatttctgcttggaaccagtctgtcttgccacagaagttgctccccaaattctcggttctcatcatcataaatcccttatcgccaaacttccaccatccccgttgtttctgcttcttctgggagcttggagccctggtacatcttttaaaatgctataattattataaatgcaaagaaggagaaaatttggttctcactgagtagctcctatgggctctgattgtgacatggaattaagtttcctgtagaaaactgttagatttgccaagtcatagatctgggtaagctaagtagcaatccattgtaagatggaaaaggtacaactagaactgagcccaagcaagactagaggacatgagaagctgcatgggcagggagcaacggtccccatgtcgcccatcacaactgcatcagcacccctccctcagctcacatctgtggccatatgtgggatcccataggaccagctaaggaaaagaaaaaagccttagcttggtttatatttgggttggctcagtatacaaatacaggctgaaaatgaacagctactatattaaccaccacactcagggtaggctctaaataaagtagagaagaaaaatattgttgatggatggagctgcaagtaatgcatctggtcatctactttgcatggaaagacaagtggccaagataagaacatatatatactcatgggaaatggccagtgatttaatggaccagttagaggtctagaaagaaaatgactgggtacttggagacaaggagatctggagtagaggcacgtggacagacccgtggaaatgggcataaagtgtaaagatttttgtgtgacgtgttaatgtccattataaagcatctgtcacagaaatgacattggatatacaaacagacaaaatgctcagccagtttacattagtcagcattcatcattggttcctccagaactggcatgatagattgtcaaatggacccatgaatagagtggtcatggtagcagagatagaggtcccacatgaacgcaactgcatggaccaccacttaaaaagactgacatagctattgccccttctgaatgtctaacctgccagtactagagatcaatgctgagccccaaatatggcactactttttggggacaccaattgatcacttggtggcaatttgttctcatagcagtagatacctgttttgggtgtgggtctacctttcatgcctgcagagcctcatccagcacattatccagtggcgtatggagaaactggcccacaggcatgggatcccacaacacgtagtatctgatcaggataaccatttcacagtgaaggagctgcagcatgggcccatgatcatggtatccattggttgtatcacttaccatatggcctagaagctggcacttgatagagcattgaaatgttctggtggcgcttgaggcaatactctgtgagaatggggtgtgggtgccttcctctaagacatgatttaagcactgaatcagagaaccctacttgactctgtgtcccctgcagggaaaaatacatggataatcaagggggagaagcagaagtggtcctaagtagcatcaatcccagtgacctattgtgtggctttatgcttccctaacccacaacattggggtctgcagtgtgagtggtactggtcccaaaggtaaaatactctctccagaggacatgtcaaaggagaattgaactacacactaaaatataggcatttttgaattccttgtgattagggaccaacaggcaagaaaaggagtcatcgtgttggcagggctaattgacttaataaaaaggaggaggtagggctatgttatacagtggggatggggaaatatatttggaagtgaggtggcatcacctggtgaattatgactacagaaggataagtgccgccagcccagcttcataaaggtgtgattaccagggactcatattcctcaagagtgaggatttggttcatgttaccaggtgagtcacccagtccagctggagtagtagctgagaatgagagaagttgagaatggatagtggacaaaggagttgatgaatactagttgtgactccaggaccaacagtgagtgggctgtaggtcatcccatgaacctccctcttctaagttttcccataagaagtgaggcccttgggaacccaggaagagctgctctataaacgtgtatgaaagtggaatcacatggcacaaggggagcactgtggcagtcatggaggtgtggtgccgagatcttccttcatgaaagaacttgccatccagctgtcaggaggtcagttagctgacagcctccagctgtcaataccttcagatttgcctctgttaagtctagacaacaatcttcttggaaggtcctagccaatgactaaatagggcaggaggttttagggtcttgccatttctgcccaacataagattccttcaataggcaatcttagtttccactgggttggctaagatgttggcagatgtgcactgtgatctgagactccttctgcccaattttgcttcctctcttctttcttttaaggtctgcatcacagtctaaagactttccttcctgatctttctttctttccttttaaaaatcttttacaggcgttaccctccagtaaatcccttacacttttaaactctgtctcagcatctgcttcccaaagacccaacttacacaataacctagctacttttggaatgtaggtaactcaatttctttgaagcaggtactatgtttattcaaatctaagttgtaattcaaggatgtggagcaaatggaattcaagtgcactatacctcgtaggtatgcaaattggtacaactagttcagaaagtatttgagaatatttattaaaggtgaacatttgaattccctatgacccagccatttacttctatgtatgtatccatcagaaggttgctcatagcagctcatgctatggactgtattgtgtcctgaaattcatatgctcaatgtgatggtatttggagatggggcctttgggaggtaatcaggcttaggtgaagatgtgggggtagggccttcataatgggactagtgcccttataaagagacatagagagcttgctgtcactctttctaccctgtgaggacacagtgagaaagtggccacctgcaagcgaggaagagagccttcactagaacccaatcatgctgacaccctcctcttgaacttctagcctccagaacaatgaaaaataaattcctgttgttcaagccacccaatctatggtattttgttatggtagccagagcagactaagacacagcactattcatgatacagttgactcctgaacaacatgggggttaggagtgccaaccccccatgcagttcaaaatccatgtataacctttgattctccagaacatagctactaatagcctactgttgaccagaagccttaacaacaacataaatagttgattcacccatattttgtatgctatgtgtatcatacactgtattcttacaataaagtaagctagaggaaagataatgttgttaagaaaatcataaggaaaagaaagttgttcctattcattaaatgtaaggtcaccatcagaaaggccttcatctttgttctctgaggaagaggagaaagaagagggattggtcttgctgtctcaggggaggcaaaggtggaacaggtggaggaggtggaatgggaggcaggcacactcagtgtaaaatttattgggaaaaaaagtgaatctgtgcagtttaaatgtgtattgtttaaggatcaactatagtaaaaaaactgcaaagtatccaaatgtctaccaatagtagaatggataaattgtggtatattcacagaatggaatacattaaaacaaccagaacaaacaagctacaaacatatgcaaaaatgtggctgaatctcacgtgtaatgttgacccccccaattaaaccagactcaaaagagtacatattgtacaactccattactataaagttttaatccaggaaaaatgaatccatgctgtgaggagccaggagaatggttatgggaacgttgtgattaaaagtggccatgatggggatcccgggtgctgctcatgttctgtttcttgatctgagtgttgattacatgggggttgaattttggaagtttgttgatccacatgcttatgatatgtacaattttctgtatgcacaaagtttatacttcatgaaaaagtttatagaaatctaaggttgtcattaattttaaggtggaactttatataggttgctatataggtactgtgtttcattaatgtataagacacacattcttttcacattttaatatcctaaatatggtgatgtgaattgtgatgggtggtggtcataaagtggttgccatcatgatgtagttgttgttgcctgtacatgtgtgaacaagcctcagaacttgcaaaaggggtaggcatcagaagcttggaagaaaatttcagattccttgtgcttttttaaatcacttataatttttatatttattgaaaaaactcttttagacaccattagacacagatttttttcatatagagctctcacgcatatggacaaagagaaatataagcaaaataaattggttaaggatttctaagtctcctccacattcagagtccgttgttctgtaatacctttttactgagtcattcgtgttgtcttttctacataatgttatcctccttgccatcagaagctttggtggctcagcatttctttaaacaatccattaaaaaacccaaaagccattggttctgggttcttattaagctggattttcagtgaggtgctgccagccttctgtggtgggagctatcatgtgccacccagattctccttcagcagtgaagcatgcatgctctctgatgctgggagtgctgctggcagagagcctttacctgtcagtcccctttggagactgggcctttgaagggggcactttaaagagggccacctcatccaaggttgtgcttccttccccaaactggccaacacatgggtataaaggcctggtcccttgtcccaaataggaactagtagaaaggatcatcccagcttcagagttcctcatgggttgggctgaggcctttattgtgactgtgtcacaactcaattttttcctctgtccaatcctgcttccttccaccagtagtgaatctaagagcatcccctaataaacctctggcatagttatatccatttcagagtctgcttcctgggaagcccaatctgcaacacctacttttgactcctgtttggggaatgtttgattgactgcttctctcacccctccctacaaccattttattcctaaaggtaatgactgcttcttcattgctttgggattttatccaaagttgccaacacctgctcattttgcaagttttgaagctggtatgtttgaccttccacattaaacagacaatggccaattaaatgctactgtaagaggccattgattataactctcagccctgtttcagaggtatgaaaaatgtgaagaaaatttgcatctttcagggttgttctcctattcctctgggtttcttttgggtttaagaggttcagatgacctcatggctttagggatgggtattttgtctgtgggctgcatgaaacaaggctggcctctgctaaacagccttgtcctgcttggcctttggtagtggcctctttccttgattgccaaaggtcgcagctggtccattttcttggcttgacctgtgcctaagggtctctgggagttttgggcctctcctcagttctggaagatcccttgaggtctctctgtgacttgggccctccaattcaggttgctgtgccccttgccctggtgaactcttccactccctctcagctgtcatctgagaaacagtgggtcctctctctgtctaggtcagccctgccactatttctactccatgctggttacttcatgttggcataggacacttggagggttttcttcctcctagcactccaggggagaggcagggctttctccagaccctcaaacctaagtccttccttccctcttcagggtttcaacgttaggagggggcaggaccacagcccccattcagaaacactcatctgcatccaaacttcttacctttctccaagccttcttcctgccttaagcacttatttttttgagtatgaaaatggcttttacatcattttttgggtcctctcaagtctgtggttcatagtacaaatctctgtggttagtcctctaagattggctgatgatatttaaaccctagtttctggaattctaagcaaactgacttccttcctttcttctttctctctgcctcctcttcctcccccttgtctttctcctttgccttctgctaaaatctcaacaaagtctggccctttcaataaaaaatgctttacgtgtgctctgagttaaaaattccattcagcaattgacttacttgaatcagtttgtatcaaaatatttttcccaactccagatacctatcacactttgttctccgcaatgaattcatcttctgtctcaggtccatgaaatgtttaataagagtgatcagttattaagccacaagaaaaattttaatacgttccaaggacaagaaatcacgcaggccataatcttggaacacggtgcagagaaactgagcattaacgccaaaactttaaaaataataaaaacccaacaacacactcctacataacttttagattaaagagaaatcaaaactataattacagattatacagaaacaatgacaacaagaacattatataaatgagaaggccaaggttgtacacatagaacaactagaggttttaagggcttttgtaattagacaagcaaaaagaatagaaataaatttttcaactagaagttaaaaagagagccaagagaatatgaccgggaaaatagaaagaagaaattgataaagactaaagcagaaatgagtggttagaggagagaaaataaatgaatttgaaaaataaaccagagatagttctttaaaacaccagaaaaaaaaaagagaaacatgtgcaaagctagtcaagataaataagaggaaaaaacaaacaattgggatgagaacagaatataatgacaagtaaaggggagatttagaggttttattttgtagattatgttgaactctgtgctaaaagttgtgaaatctgggtaaaatgaatgatttcctaataaaacatacacaaacaaaatttattagagaagaagagaatataaatatactcatgatcttagaagaaaatttaaaagttgtcaaagctctcccaaaatgtgtctagattttacaagctaattccatgagaacttcatggagcacatcattgccatgtggtttagactgttccagggcataggaaaaaatggagcatgattcacttaattttgccaaagtagcataatcttggtatcaaaacttgtggcagaaatctactaaaatcgcagatgtgaatatggttccaagaatcccaagtaaaatactaacaaatcaaattcaatagaacaacaaaagaacaatatgatatcagggtttttctaagaatgcaggcatagttcaataatagaaaaatctcaaacattgtaggtggggaaataaattgatacagcttttggggaggataatttggtacaatctatcaaatttagaaatgcatctaatgtgtgacttagcaattcctcttacagttatctgtatcctaaaaaattatgggcacaagatgttagtacaagaatgtttttactgcaacattttttcttggtaatacaaaaaaagagaaacagtctaaatattcatcagtaagagaatgattaaatcacagtgttaccaccatacttaggaatacatggtagcagtttaaaaagactgttactttctatgtactgaaacaggaaaagctctgatacattaagttttttttaaaagcaataaaacaaacaaaaaactaaatttgtgagctaaatcatattatagaatgatcccattaaagttaaaaaatagagctatatatttatatatctacacatgtaaatgtaactgaatataaagaagatctgtctacaaaagataacttgagagatgagaatgggatcaatggagatagtagtgggggccaaagaggtgggactttttaaaaaaatacaatgctacttttttttctttccaacttttgttttaggtttaaggggtacatgttcaggtttgttacatgggtaaattgcatgttgtgagggtgtggtatacagatgatttcctcacccaggtaatgagtatagcacctgataggtagttttttgatcctcaccctcctcccactttccaccctcaagtaggctccagtgtttgttgttcccttctttgtgtccatgtgtactcaatgtttagctcccatttacaagtgagaacaggtagtatttggttttctgttcctgcattaatttgcttaggataatggcctccagctccatccatgttgctgcaaaggacgtgatttcattcttttttatttaatggccgtgtaatatttcaaggtatatatgtaccacattttctttatccagtccaccattgatggacacctgggttgattccatgtctttgctattgtgaatagtgttggcaatgaacatacatgtgcatgtgtctttatgttagaatgatttatatgcctttgggtatatactcagtaaggagattactgggttgaatggtagatctgttttaagttctttgagaagtctccaaactgctttcaacaggggttgaactaatttaaatttccaccagtagtgtataagcattcccttttctctgcaacctcacctctgtctgttatttttggactctttaataatagccaatctgattgatgtgagatggtatctcattgtggtttgatttgctcttctctaatgattagtgatgttgagcattttttcatatgctcattggctgtatgtatatcttcttttgagaggtatctgttcatgtcctttgcccatgtttaaatggggtttttttgcatgttaatttgtttaagtttcttatagattctggatattagacctttgtaagatccatagtttgcaaatattttctcccattctgtaggttgtctgtttcctctgttgagagtttcttttgctgtgaagaaactctttagattaattagattccatttgtctattttttatttcattacattgcttttggggtcttcatcataaattttttttttcttaagccaatgtctagaagagtatttcctaagttttcttctaggagttttacagttttaggttttacatttaagtctttaatccaccttcagttgatttttgtatatggtgaatggtagggggtccagtatttatattctgcttgtggatagccagctatcccagcactatttattgaaaagggagtcttttcctcattgcttttgttgactttgtcaaagatcagataattgtaggaatgcagctttatttctgggttctctattctgttcccttggtctatgtgtctggttttgtaccagtatcatgctgttttgtttactgtagcctggtagtatagtctgaagttgggtagtgtgattcctccagctttgttgtttttggttagaattgctttggttattcaggctatttttggttccatatgaattttagaatagttttttttctaattctgcgtaaaatgttgttggtagtttgataggaatagcattaaatctgttaattgcttgggggcagtatggccattttaacaatattgattcttcctatccatgggcatggaatgcctttccatttgtttgtgtcatctgtgatttctttcagctgtgttttgtaattctcactgtagagatcttttgcctccctggttagctatattcctaggtattttttttgaggctattgtgaatgatattgcattcttgatttgggtctcagcttggatgttattggtttgtagaaatgctagtgattttcgtacatagatttttttatcctgaaactttgctgaaggtgtttatcagatctaggagcctttgggcagagactatgggattttctaggtataaaattgtatcatctttgaagaaagatagtttccctttctaattttctatttgcatgtgttttatttctttctcttgcttcattgctctgactaggacttccaatactatgttaaataggagtggtgaaagagggcatttttgtcttgttctggttctcaaggggaatgcctccagcttttgtctattcagtgtgatgttgacggtaaatttgtcatggatggctcttattatattgcagtatgttccttgatgcctactttgttgaaggtttttaacctgaagggctgttgaactttattgaaagccttttctgcatctattgagatatcatgtgatttttgtttttagttcagtttatgtgatgagtcacatttattggtttgcatatgttgaaccaaccttgtatctcaggaataaagcctatttgattgtactggattagctttttgatgtgctgctggatttggtttgctaatattttgttaaggatttctgcatctacgttcatcagaaatattggcctatagttttcttttttcattgtgtctctgccaggttttaatatcagaatgatgctggccttatagaatgagttagggaggagtccatcctccttgatttttggggaaatagtttcagtaggattggcaccagctcttctttatacatctggtagaatttggctgtgaatccatctgctccagggctttttctggttggtaggctttttattactgattcaatattagaactcattatttatctattcacggtttcagttcttcctggttcaatttgggaagactctatgtctatatctattctagattttccagtttgtgtgcatagagatattcatgatagtctgagggtttttttgtatttctgtgggattgatggtaatgttttctttatcatttctaattacatttatttggatcttctctttttttctttattagtctagctagcggtctatcttattctttcaaaactctaacttttggtttgatcttttgtatgatttttcacatgtcaattttatttgttcagctctgattttggttatttcctttcttctgttcgctttggggttggtttgctcatgttttgttagttcctctggctgtggtgttaggttgttaattcaagatctttctaacttttctgtgtgggtgttcagtgctataaactttcctgttaatactgttttacctgcggccaagattctggtgtgttgtaactttgttttcattagtttcaaagaatttatttctgccttaattttattgtttacccaaaactcattgaggagcaggttgtttaatttccatgtaactgcgtggttttgagagatcttcttaggattggtttctgtttttattgcattgtggttcaagagtgtgtttggtatgaagattgttttatgtctgattgtgtggtcagttttagattatgtgctgtgtgcagttgaaaagaatgtatactttgttgttttggggtggagagttctgtagatgtctgttaggcctatttggtcaaatgttaaattcaggccctaaatatatctgctagtttcttgcctcaatgatttgtctaatactgtcagtaaggtgttgaagtcttccactattattgtgtggttagctaagtctcttcataggtctctaagaatttcctttatgaatctaggtgctcctgtattgggtgcacatatatttaggatagttaggtcttcttactgaattgaacactttaccatcaggcaatgcccttctttgtcttttttgataactgctgatttaaagtctgttttctctgaaattagaatagcaacccttgtttttttctgttttccattggcttaatagatttttctccatccctttactttgagcctatgagtgtcattgtatgtgagatggatctcttgtagatatcacagaattgggtcttgcttctttctccaacttgccattctgtgccttttaagtgggggtgtttagcacatttacattcaaggttaatactgatatgtatggatttgatcctgtcactgtgttgttggctgtttgttatgcagacttgattgtgtaattgctttatagtgtcaatggttcatgtacttaagtatgtttttgtggtggccagtaacgatcttttgtttccatatttaccactctcttaaagacctcttatatgacaggcctggtggtgacaaattcccttagcatttgcttgtctgaaaaagattttatttttcctttgcttatgaagcttagtttgggtggatatgaaattattggttggaatttcttttctttagagtgctgaatatagacccttagtctcttctggcttttagagtttctgctgaaaggtttactgttagcctgatggggttctctttggacatgaactgccccttctctttaactacttttaatattttttctttggcattgaccttggagaatctgatgactgtgtcttggggatggttatcttgtatagtatctcacaggggttctctgaatttcctaaattggaacgttgatatctctagcaaggttggggaaatttttgtggacaatatcctcaaatatgttttctaatttgcttgcactttcttctctttcagggacaccgatgagttgtagatttgctctctttatataatgccatatttctcagaggttttcggtcattctgtttatttatttattttgagatggaatttcgctcttgttgcccaggctggagtgcagtggcataatctctgctcactgcaacctctgcctctcagattcaagtggttctcctgcctcagcctcccaagtagctgggattacaggtgtgcaccaccacgcccagctaatttttgtatttttcatagaaacaggctttcaccatgttggctaggctgatctcgaactcccaacctcaggtgatccacccaccttgaccttccaaagtgttgggattacatgcgtgagccactgcacccagcctggtcatttattaaaattcttttttcttcatttttgtctgactgagttgatttgaagaactggattttgagctctgcgattctttcctcagcttggcctattctgctgttaattcttctcattgtattatgaaattcttgtagtgagcttttcagctcaaatcagtttggttatttcttaaaatggctattttatctttcagcttttgcatcattttgctggattccttagattccttggattgggtttcaactttcttctgaatctcaatgatcttcattgtcatctagattctgaattctatgtctgtcatttcagccatttcagccttaggaaccattgctaggaaggaaaggcaattgtttggagggaagaagacattctggctttttgagttgccagagttcttggactggttctttctcattggcgtgggatgatgttcttttaatctttgaaattgctatcctttggatggggctttttgcttttatattatttgatgcccctgagggtttgactgtgatataatttgggtttagtcaactggcttcatttctggatgaatttagggggctaaaattcagctcagcactcctgagctgcatgctgtaacccttggggactgggtccaggcccatagctttattctctggcacctcgaggttataaacctattgcactggagggactgagatattcctggtcttctggcaacaacactgatcagggatgctagaaaaagcactttgttggggcagtaacagtggggtctgtgcttgcacgtgcacaccagtggcagcggtgcattggggtctgtgcatgtgtgtgtactggtggtggtgggttgacagtgtggtggcgtccatgtatgtgcacatgcactggtggtggcagtgtggtggggtttacacacatgtatgtcagtggtggtggggcagcagtggcaaagtccacgtgcatgtgcaccctggaaatgcagcggcaggaggctgtggacaagtcacaccagcaaagtggtgaggggaggctgtgggcaagtgcgtgctggtgggggcctctctgaagagatgttctccaatggttaggcagagtctgctgacgaaggagctatggcggtggctaccaggaagtgcccaggttgggcagccaaggctgtgctgcaagcgggcatggccatgtagggatcccaggagaggcaagtagacaggggggtgctaagacaagactggcccagttccatgggcaagatagccctgctctgtccaggtccaacatccaataaagggcaaagcccactcaggagtgtggcgagcattggggcgtccctggccatgctccactgcagctgttcccacaccaaattctctgggctccacctaggcaggagttccatccctgccacctctccaagcagctctctctgccagctcaaatgtctctgggcatggtggggtctcctgcagctaggattccagaggcccgtggcaagagtgggccatgcctcacttatttaactcagagtgggccagtcttcttgacggtctgcactctcagtgggagatgctctttttgtctgcatctagtcgaccatcttagatctagaacttttatcttttgtatctagctctgtattgtttaacatttttccaagtaggatatcctcaaataatatttgtgtaactaaatggtaaagaaccatgtaaaacatactataataattcatcccatcagtagtctaaagagaaaaaaacttacacttgatggattccagaaaattttctaccttctacttattccttgaaaaacatcttagtaaataaggaagataaaaaacttttaaagcaaatagtatcaggaatacctttcttaaaatgatgatggtcatcatatttcacagagaaagggtaaaacattacctaataaagtcacaggcataaggcttgggattcaataacatgattattatttaacactcttttcaaaattttggacacttcagttcaacaagaaaagaaaaagaacccactaatcttagttgacagagagagagagagagagagagagagagagagagagagagagaggagatgtcaatgttgttaagaaggattataaaatttacagatgtgataatctacatgacaaacccaagaggctcaacaataaaaaattacttgcatatgccagtgcttcctgcctgccaggccctctgctaagtgcttcataggcatgatctcatttcaccctcacaagaatcctgtgaggtccatttattattgtttctattttatagaaaaggaaattaagttccaggaaattaagttccagacaggtgaagaaggcagtggctggtgaggtgtggagccaggatccaacctgagccatctgactttggagctgcttgagtttctccagccctgctacatactttaaaagccaaagaatatcttccagtaagctgtcaacatataataaatatatttttaaaagcaataggccaggtgcggtggctcacgcctgtaatcccagcactttgggaggccaaggtgggcagatcacgaggccgggagttcgagaccaggctgaccaacatggtgaaaccccgtctctactaaaaatacaaaagttagccgggcatggtggcacgtgcctgtaatcccagctactcaggaggctgaggcaggagaatcacttggacccaggaggcagaggttgcagtgagccgagatcatgccactgcactccagcctgggtgacagagtgagactcagttccgcaccccacccccccaaaaaaaacccaataacattcatatataagatcaatggccaatctggaaatatctgggaaaaaatacattgtatttgccatgggatgaagaattatgtattatccagcagcatgcttaaaaaggaccagcataaaactttattgagaggtaaagagaaaacttgaatacatggaaagacatgctcatttgtagcttggaagtcagtattaaaaaggtattgattattctgacaatttacaaatatctggcaaattccaaatacattatcagcatttttgtcagagcttgactgacttattcttttaagaaaaatattttatttcaaaaactcattatattaaaaaagtcattaaaaagtgtgtctaaaaaacattttcttcagaagtaagcattgtttatagtgctctctaacacataagcagacacacatggctctgctattttagcaaaataatgtcaaagtggcacgtgcagctggctcaagtgggtcatgagaatatattactacatttttaggaattttgtgagctgattgataaacatagccattattaaaaatcaaattacataaactcacaattaaattattttaaaaacacaagtaataatttcttaaaacttcgaatcacttcctaatgatcttgttacattttgctattgtgtatgcttttgaggtcatttacatctattgtatctgcatcatgggcatgttatataatggtgtgctgctgtgtatatcttctcaactctgtgatcagtgacatcatgttagtagcttgaaattgaccatggtgggaatatttggaccatggaagttagcaaatgctacaattcaagaccttgtcttcttttcagagagttggtttttaacgtaacagcacactgccggattaaaattatgctagcaggagtgatatgtatttcaactgtacgtgtgtatgtatatgtttggtgtggtggtggtggtggtgctgtgtgtgtgcatgtgtgtgtggtgtatgtgtatgtattttttcagcaagatgtggagaaaagcaaattatagctccctagttagaaatagaataaatgaggatgagaaatacagcttaatactacatgaggcaaaaagggtttcctatgacaaagtacttaaaagagttatcaaacttaaacatgtcatgaatttttcttttataaatggaaaacgttccaggtttgctgaccttttttgtgatgaaagcggtgtcaataaaatgtacctaaaagatatttggaaaaaataaatacacttgtcttttcaaggccaagggtatgttgtaacaagggtgcaaaaacaatagccttttaaataaattcatgctttggggagagtatactgaaaatggagagtgaaagtgtctccagggttatgtgatttcgaggctgaaaatgacgtaagcaggccatctataaaaactatcgtatctgtttactttaaaaacttggaaacaggatattctaaccttataaaaaatcttctaaaataaactggttttttagtaatgtgaaaagataaatcttctaattattttgtaagtacaactgattgacatcaggaaaaatggaaattattagctgaattttaacaaagacctctgcaaaattggtgaatgaggctgaaaatgattttcactatttttaggcatagcccatgaagcacttctttcatttgttatctatgcatattggcgaagccccttttcagttatttcaaagccatgtactggaataatgtgaatttagacctaggactgcacacagcaacctcacagtgttaatgattattaaaattcaagcatatttacctttgctaaaacacattttttaaaaagtgagaacacaaagatgctgtgccctaataattaaaatgaacatgaaaacatttttatgataggttcacggggcacattcgcaggtttgttacaaaggttatattgcatgatgctgaggtttggagtacaattgaacctgtcacccaggtacagtgcatagtacccagtaggatatttttcaacacttacccctccctggccccctcttgaatttctcagtgtctattgtaaaataatgttctaaaaaacagtttattatttatattttccttttaaaattccaaagtgtggaatttgggctggcagcatcggcatcccctgggagtttattaggactgcagattctcaagccccaccccaggcctcatcttattgctttgagttaaatggaggaatcctctgcgtggatgagttttgccataagtacaatcaggagatgacagagctactttgctctttggtgggtgggtaggtgagacggttgagagtggtctgttcttctggttgagattttgaagactagagtagttcttgatattttgaagtatatttatattaaaagagactttcttggagtaggtgaagccactacatggtgtaattcccaaccctacctttatgatggcaccaaataggataattctgcaataatactagctaacatgtaacacttaccatgtaccaggcattgtcctaagttcttcttagagaagaatttgggcctggtcagtctagctccagagcccatgaataaaccattatgctatactgcctgggtataaaatatataaaggaataaatacccacaaattagggatgcatctgcagatatttttattgatggggaacaagattaaaaaaacatttggggacactaggctagtggataccagctcaaatgctactgtgacataaaaaacctttcctaatctggcccagccaatgtccctgaccccacttcttgctctgcccccttaaaacctgtgctctaaattccaccatcttgaactggcatcctggcagctccctgaattcctaatgcttccttccatccctgactcctatctctccttcagaactcagcctgggtaccgcctgcctttcctaactatttaatatctgcccttcccccaaaaggccagtccaggcatcctttgtacactctcagcattgtctgcatactctgcatgacatttgtcctactattttataataatctattcacttgtttgtctaccagccttgagggcagcactctatcttgtttatttgtgtatgtcctcgtgcagagcctggaacatattaggtgctgtttgcatgaatgaatgattgacgaaagagaaagcaaccattgccctaggagttgttctaggatctgttatttgtttaatggccaccagaggggggcagacgaacagggtccagtgcacagcacccatctagaactctgggtagagaatgtaaatacttattctagggctggaagggaagttcaatggtcatgtaaagcgttcctctgttttagacaaaaattaaacaaacctttccaggtaagcacagtgatatttaaagttttaagtcaaaaagaattgtttgaatctaggcagactttaaatctgaagagttggattctggttccaattctaacattatttagcttgtctgatctcagatgagacccttggattttggagactcagtttctgaatctgacaaatgggtgacatactcattttttctacctcctgggagtgttttgtgacccacaggtaataatgcacacaagcaccctaaaaatgacaagtaacaaataaagtataataaaaatcaggggctaaataaaaataatttcaatctcccttgttcaaaattagttttctgaaatgtgagctgaaagccaagtataagcatggagttgaaatgagcatggacttgtgttgagaccacagatgcatcaagatttcaagctgtgcattatttaggccattttattcatttggctcccatttgaccacctcagctgcactgccagaggccagctaatccctctgcatctagcatcatctatgcctggataattcacgtatctcaccacacatgtatatcatttctttcttttgtaaatgtgcatgaatgttgttacaatgaataaaacacaaattcatagaaaaactttcatgagtttccagtcacatttaccataatctattttttcttaagagatggggtctagctctgtagcccaggctggagtgcaatgtcacaatcatagtacactgcagccttgaactcctggactcaagcaatcctcctgcctcagcctcctgagtagctgggactacaggtgtgcaccagcatgcccagctattttttttgtagagatgggggtctcactatgtggcccaggccagtctccagctcctggtctcaagcaatcctcccacctcggcctcccaaagtgctgggattgtaggcatgagccactgcagctggacccataatatattttaaaaatcaacatatatttaaaaatatatttaggattgagttgcattatatgcatattgaacctatgcaaacatgactctgtgggtttagcaaaacaaaaagaaaagaaaaagagaaaaaagaaattcttacaaacagcaaaacagaaattaaaccaccatctttttttttgagacagagtctcactctgtcacccaggctggagtgcaatggtgcaatctcgactcaccgtaacctccgcctcctgggttcaagggattctcctgcctcagcctcccgagtagctgggactataggcatgtgccaccacgcctggctaattttgtatttttagtagagatggggtttcaccacgttgatcaggctggtcttgcactcctgacctcaggtggtctgcccaccttggcctcccaaagtgctgggatcccacagtcttttaatagagttggtgatttggctccatgaagggatggatgcccaggctgagcacagattggtggatgtgactgcttcccctcagtgggtttcagctcttgcccaaacctctcatgatagagtgtatttctgtatttgtcagtaatttaagaagttttaaagggaaacttttacatgagcaatcattttgtcttatatttatcttttgaagccagctcaccatagaagatgctactccacatgtggagggaacatgacattttggggcacaaaataggaatccatcagtggaaacactgatctagcctagaaaacagactcccagtgccttcccagagattggggtggaacccagacctttctcgttaagatcagtgctctttctacccacagctgtgctagttaacatgccttgcactctggagcccatcctccccgcaggcctgggggaatccgtgaacgcctaaactgtgcatacagccgaggctactctttcagtacaggcagtctatccccacgcagacagtttttactcacaaatgtttgtttttcagggtcctgcctggtcatcatttccactgtctttcatgtgttacctttatattggaatcagaatgtgagctggaagcaattttcaagccggttttgaacctcggtcagggcaatcagaggcatgtgtgaagaaatcgctgaggctgggcagccttcaggccaccagcacttggtttccttttctcccttcctccctcagtaatgtgacggccagatgcatcctatgccccagcaccacctcaccctctggcctggtttttgagcttccttttcctcttgggtgaggccatgtttccttgatacttctggcctctattccttgaaggccggaaggcactcttggggcgggggagggccagtccctcgacatggaggggagggtgctgagaggggtgggggcagcaacagcagctggcaggcccagggtgtgagcgggcaggcctctgtgggcaccgggacaatggctcgctcaccccctcaccctctaaactcagcaaggctgaagcgctgtttggtgctggcttccctcctctctggtgggtgaagaggtctccctatgaggggaagttcagcattgagcttccacagcaaactctccaaatgccaaaggaggctgtggaaattaggattatcatggctccagaggtttacggaccatcttgaaaatctgaggtagattttatctggggtggtggaagttttctctggctcccatggctggctggctggcctgagcttctatggacagaattttgttagatcccaaggaaaacttgccaatgctgagagctcgtagacaccagaataggttgtgaagacagtggaatctactttggcggtccttaaaaatagaataacttctcttcactctgtaatggtctggaatgacagtctgttaaaaaaaaaaaaaaaggaaaacatgacaaccacaaagctcttaattttcaacaactcttgagtttaagctgttttagatttgctgcaagtcctcacatcctttgattgcctgtacaatattaaacacatattgaagacgctttgcaacatgcccagatactagagctccaacgcagaggaaggaaattaatatttggcagaaaatcccagggacacaactttgtttggaaaattatgtctaccacacaaatggaaattaaaattcacctctgagggactgataggatttttccccattaagtaacctcctacctctgtttaattgtgtaaggaagtttgtaacctctgcatactctcgccaggctctgtcctcatttcctcacctcttttgtaatctaggtcccaagacttctagaagactctctcgatgggtctttattccccaatcgctgctttaacagagacatgtggaggcaggagactgggacgagggaggcagctgagaggcagttaagggaacactgaaccgagaccctctttcactccctttgccttctccagccataccctcggaccttggtcctctatacttggctatggtttctgaacccaagcaatgacatgggatctgacaagggcaagtgtacttatgggcaaagcaggatgtggtgtacttgagactggttctgtcccagggaattgggaatcctagtgatgggtcacatacgaatcccctaactaaaaaatcaggtacatgccagttcacttctttagaccttgtttgtgtggcaagaatgtcacatacaaaagaattcatgcatagatgaggccatgtcagtcatgacttagtgtgagagccattttaggatgttgggcagccctgggcatgcgatctttggtggcgtctgcaccatcccaaatgcagtaaaaggtccttccacctccttgggaagtacatggatgtggcagttgacatcatataatgttcaacgtgcacttaaacatttattgaattatatttattctatttgagagacaatatcattttttttaggtctcaaatatttcttagggcattcaaaattactgtgcctgtagagccagtggataaaatgtcctaggcatggaacactggcctagaggactagacatgaaaaataaagtatgcatacccctttagcaataccctgcaaatgcaaacataagcatgaccttaaaatgtatgtttatggtgaggagagggcagtggtgctgttgagagaaggaagagtctcaaaatttccagtgagcagaaattacttgactcatcctgactgtcttctcatcctgactgtcttctcattctgactgtcttccttgggagtgaatggaaagtaataatgttaattaaaggggagcaaatgtccttaggtttgcctttatttgggggaatagtttttgttttatttttagggaaccttcaggctgcttcccaatgatggggcccatgactttggcactatagttccctcatcacaaagtcttccaccatgaaggtctctaggacccccaccataggtatgagactctttccatttgtaaggaatggaggggaatactcagttgaaaatttgacgatgggtattcacattcattttaaggatacacaaggaaagtgaggagtgctgttttgtctcagcaagtgcactgttatccacacgacaaatatttgttgagcaccgactgtgtgatgactgtgttctaggctgtaaggactctagcagtgaacaagacagataaggttcctacttgcacggagcttgtatgtttgatggataagaaacaaagggcataaatgaatgaggtgacttcagatggtggtaagtgctatgaaggaaagaatctggtaacatggtaaagagggatagggagaagggtgtgaggctactttagattgcatggtctgaaagatttcttaggaagtagaattgtaaccaagccttgagagttctgaaggagccagctgggagtaggtctgggagcagaattttccaggcataggaaggtactgttgcaatgcccctaaaactttggcaagttttaggaacacaaagaaagccagtggggcagaagcatagggagtaagggtgagtgctgggagatgaggtcaggcccagagaaaaccacaatgtgttcaacactagtcccagtggttgcactggtgccccaaatatcttgtccccacagaattgaaatcaatttttttctactccattaattctgtcaccctcatgactcagtagctttttgaatgggcttctctctctcagtgcctcatcatgaacatctttctgcttttctatccctctcttaattcattttgcattaaaaattcccaagggtgaggatctgggtatgttgattaatactatctaataagaagtggtcctattggtcagagtctcacactaggctttgttattggctgctggtctcccttaggtccagcttccttggcctggactcctggttcaatcagttgtggccagggtcttatgacctagagcttggcaacttattttgaaggaaactgtaataactactttcatcaggatcaagttgtgtattgtgtactgtgccaaaattaaagagactgacagaattcttagagaaaggatatatatgatcatctcacaggctatgaacctaatgaggctttttacaaagggcttagttcttagctactcactgaacattccccagggacaactgagtctgatcctgtaccatccagatctaaacacttagaggttagctgttcaatgtaacctcttcctattggctttttctttctgccaattatatctttcattcccacatgcatttatggtatgtccttgccattttctttctcctttatctggactgactatgtggatggctttaacatacagaacagagcagaagtactttatataagagaactgcagcatccacctgttggaacaccccttcatggaacccagctactgtgctgcaaggaagcccaattagccatgtgagaaaccaaactggataactgaggcctccaaccagcagccccagctgagctcccagctgacagccagcactaattgacatttatgtgagtgaagccatttagggccttctaacaatcccaatgcccccagccaaccttagtttagtatacacacaccttaccccagccaaacccagtgaagtattcacacaccggatcaacccacagaattgtgagaaatagcaaactgttttgttcaaagtccctaagctttagagtggttttatgcagtaatagttaaccttgcaagggacagtaaatagattacactgaatgcatcatattcagccttatagaacttcagaatcagatacagatagcaagggctgtaggcctatgaaaattgaaaatgaaattttcattttacttgataattgtttctttggagaatcaatagaagagaaatcctttctatcccagtgacaggcagccgaggccacacttgaccctatcgtggtggtggtgatttagggagagactgcaggcatagaaaggcagggaagggagggaaccggagtcaattcatgtgtcgatagggaacattaagtctgtgacattttgctcagaaggttcagaatttggcattgttgtttcctatagaatgagggaagttcacatggatattatttattattcggatgctaattctttgaacggtgaaatgaaaaacctcctgctttctctctcccctttcctttcactttctgcttctctttgctttgctcacacttttccttttttccttcttttcaaagagaagaaacaacaacaatgtccaaacctgtttttgtgctccagcctgaaattcagatttggtctttacccaaagtcaatattttgggagaagtttgaactaagtcattcatgcaatcttgcgtttcaagtatgaaaaatccccacagttttctacttaaaaggaaataaaaagtctgaaagcgatgtaccaaaaatctatcaaacactggaagctgtcaacttcaaacctggcaggaaaaaataatcaccaaaggcggaaattcaagtcaagtgtgagtagagtggccaaagcttgtaatgtgtcaaaggcacgtagaccagagctcacgcagggtattcgcaggtgaaaccctgcactgcaactgacctgtcactatgcaggaacctctagacaggggcctcttgtttggataattgtggcgatctcagttaattggtctccctgattcaagtctatacctttttaaaatcacaaatctgatcaggtcatttttctgtttacaaatttcagtgactgcccattgtcctaaggataaatcaatacttctcagcaggccttaagagttgacaggcatgatccagctatgattccctctctggccacatctctggtcacacccagactcacacccctttccccagtcacgctgagctccatggtgttccaagaatgttcattgctctccagcttaagtctttgtacatgttgttctttctcctggaaccgcacctcattctcaactcttatttgtccagcaagaatcatttcagatgtcacctcttccaggaaggactaggaatatcccatctgaattcccacagtatctgggaatttgtcatgttgtgtaataatggtcagcttacatgtatatatctgtcagtaaactattaactccctaagggcagttgccatgctatatttaatttttttaattcttaaaacctaacacatagtgcttggcatataatagatgctcaataaaccaatgtgaataaaaaaataaatgaatgtccctgaaccctacctacatttttgcatcatgggaagaaaccagagggatatagggtagcagggctttgaggtgaccacacagttgagacgctgagacctgaaaacaattttatgaccatgtcataattttgccaagaattaattcttccctaaaaaatgtctcctatgagaacctacatccacagccatgcaacatgacagtgttcttgttttttgaagtcttgttacaatggactctgtcacagaggcctggaatttagtcatttaattaacaaagatattttgagcttcaactgtgccaggccctgtacatatagaaacatgaagacaacatgacttgttttcctcaaggagcttatactgtagtggacaatgggtaacagggtttggttttgatttgatgctactctgggggagggctgcctcatttactgggaactcagcggaccaacgttaattctgctctaaaaaatgcttaaattttttttctaggagaaaaaaaatgaataaagctcacccaagagaataaatgtagatgacatatctcatcatggaaacaaaaccttttttttcttttttaaaaaaatgatacattgacaaataaataagacaccggaggcagatacttagaaatcaggaaattcaacctgtgtgcttctgatgtaactcagtcacaaggatgaaacagacttttctccctagaggcccagtctgtccctaaaatccttgagaattgtggtccaaattctgttggtgggataaattttttttttttttttttttttgagatggagtcttgctgtgtcacccaggctggagtgcagtggcgcaatctcggctcactgcaagctccgcctcccgggttcacgccattctcctgcctcagcctcccgagtagctgggactacaggcgccctccaccacgcccggctaatttttgtatttttagtagagacggggttcaccgtgttagccaggatggtctcaatctcctgacctcgtgatcctcccacctcagcctcccaaagtgctgggattacaggcgtgagccaccgcgcccggccaaaatgtccttgagtgagatgtgtagtaagggaatgggagatggtgagagcctaaaatgggtctttggttctctaggccaaacccagaactgatgctgggaaggatttcaatatgtaaacaacatcaatgactggacctatgtcaacggatcacaggaatataggatggatgtcacacagcagaatttgacctaaagtgattgcaaggagagcaggaaaatatgctccaaattcttctctgaatgtcatccacctaatcaactatccaatctgaaatatccactcacttttgcatttcttctcaaagttaaacttctgatatctagaaatatacttaaaaggggaacctcaggagagctatttgctttttaataatattgtaaattattgactctaattatttcctccctctgtccacaccctttgccatctatatttactatctatatttgtacttccctgacctagacttgtgctttagccaatggaatgtgagtgaaagtgataatatggcaaagttttgggtctgtcttaagtgacagtacttgattctgtttgcctgtcttgtatctctaccattaccatgagaagagcttgtcctgggaagctcctgcctcctagcaatgatgaacacacatggagtagacatgagccccaaatcagtgaggagccaagcccagctgtaccttcaacttgcttcagagatacctagctgatgctagactagattaacagaaccacacccaacctttgaacacacaagcaagaattaatgattgttgtttaagtcaccgagttttgggttgatttgttacccagcaataaatggctgctacaaataataataataataatagccaatttgcctatgacttgaccaggatcattcagctagtgaccagtgcagatggaattcaaatctgcctctaaattccatactcttaatcacttccttatatgatcttgagaaataaacctagttaatacttaggtgagttattttcaggcagaaatttttatcctggaattaagacaatatgagaaaagacatacatttcttttcacatggattacagggaagaggagagctatagtcataccagaataattcactcataagaaaattcagtcagggcccccagatctgacagagagggaacagcatattaaaacagaaaactagaagaaagcaggattcaggatttaaaaatagcaggccataaaaagtacagatgaagggctgcccagtatgaccactatcatgctagaatttgtctgcctcttactatctttgtggtcttctctgtgccttagcttttcatctatgaaataggaataatgaaagtaactacttcatcaggctgttcagaggattgaatgagttggtgtgtgtcaagtgctgggaagagtgtctggcacattgtaagcagtgtatgcgtgttagcttagtggtgcctctagaagggagcaccatacttaactatctgcctggtatttctgactccaccactgtgatggttttgtattgtgtcaacttagctactagaactacatttcccagaattccttcccctgtatggtctagattaggagtgccatgtgaggaatctgcgtgagatttggaaggtgaatgtggagcatcagccatcactgtctggaggtcggtgtcggacacaaggggctgctgcagtcttcactcatcacggacctacacagggcagcagctgggcctgcacctcctctcctccttctggacctcctcctgtagctgctctggccaggagtgtgtgtcactccatgatggaggatcccagcttgcgggtcaccgatgtggttgagattgagatggtagaagacagatatgacttgcagttggtccctgtggatttcagttggtccttatggattcctctttgtcttcacagattttcgttttccttgcttttttgcacttcatgcccagctttccatccaaacagcctggcctgctgacccatagcaacttcaggattggcccaccaaatgcagagggaacagccttgcacagacatctccaccagctcccatcatgactccaggtccaatctctattgcaaatctgtgtttttctacatcattcatcgtggtcatgcttccttgattgaaccttgcctgatacatcccccaccacattgctctgtgagttggatataagacagtggtaccactgaaagctcaaggttctttttaacacattttgcatttactataactctaagcattttggctcccaactgccaccctttgccttctctctatttccccagaacttctctgtgggaggactttgagcaataaggaaagagtattgactgctgaaattccacagaaaaaatatccaatttctttcttcagcacagtgatgggtggggttaaccacagatttgtcatcagattttaaaatcaaagcagtaagattttcctaaaaataaatgaaaaagaaaaagaattctatttacctcaatattgctattttcacaatttcctagaacaagttgtacggagtaatacaaatgctaagaaggtgggtccaaatgaaatacagaattcataataagaggatgttgttactcagaagaaggacaacccagtgtgctttgagatggtattgcagcaatgaaaacaagctcaatgtccatgtcagataaacaattgtcgtcacagctctggaagtttgggaagtgactcatcttcaggaatgggcagtgagtgaagacaactgtttacctcagccctttggtggttgacacaaacattcttttcttcccctgtgacttggccactgggagatgctgttgcagccacgtgcatcggcaccccagcttccaccacatagatgctcacctctcctgccccgtgatgccttacactctctgccctcaggttcttactgtccttaggggtggaaaatctctaaaatcagtggatttcctggtaaatgggggagaaaataattcaggaagcctctccttgcaaggagggaccattgttaggaacttttggtctgagatgctatggctgagtccaggggggcaacaaagaacagaccagttccaaactcgatcagctagcaaaaaaaaaaaaaaagaaaaaaaagaaagggactaaagggggtgtagagactctggtggaggcagggcagagccaaaatcagggagaggatcctcccctgtcagtgggaggtagtgattgctggagtcagggccacagcaaggtcagggatggaggaatggagaattcatgcaggagaagcttggctggagctgcagtgaatcagagggtgcatcaccagcagggctctggctagctgcactgttgtctttttctgctttatctgagttgtttcattaccaggacccagaatttctactgctatagccatagagggctgactgctcaggaagcagggtggcagtggaggcatgtcatccagagaagtgcacatccttgcaccaggacacatgaacaacaatgttcacagtggcattgctcataatagctccaaatgagaaactaaccaaacgacatcaacgtcagaatggatcaagaaatggtggtatatttataagtaaactgcagctgtttatacagtggaatactatattcatttcctagggctgccataacaaattagtacaaactgtgtggcttaaaataacaggaatttatcatttcacaattgaggaggctagaagtgtaaaatcaaggtatcaggagggttggttccttctggaggttctcggggagaatctgctccatgcctgtctcccagcttctggtctttgcctgcaatccttggcattccctggcttgtagctgtcatcactcccatctctgcccccatcttcacatggtactctccctgtttctctcaatgtcttcacatgaacatcttataaagacaacagtcatcagattaagggccccccaatccggtatgaatcattttaactgattacatctgcaaaggtcctgtttccaaatgaggtcactttctgaggttctatgtggatgtgaactttttgggggacacaattcaatgagtgcaaatactatacagccatgaaaatgaatgaactacggctgcatgcaacatggctgaaacacagacaaaatattcaggaaaaaaagttacacacaaaagagtatgcactgtggtgttacactgtaaaactcaaagttaggaaaagttaaaccatagtgcttaggaatgcatagtttggtgatatataggatatatgtatcatattataatgaaaaacaagtaaatgattcccataaaagtcaggatattggttacttttagaagggaaaggagtatgagagggggttcctgggatgctggaatgttctcttttttgacatggctggtggttgcaagactgttttttgatattccatgaagcagttttattttctgtatgcctgctgtttttcacaatagagcatgggggtgtcagaactggaacctgctgttccaggttctggcaccagctgctgggtcttgggtaagttgcctccctggacctcggttttctcatctataaaatgagatggttggagatgatgccctccaagctcattaaaatataactcatttaattctccaggcatttctcgaggagaggagacccccaacattatgtttacaaaaaaggaaactcttgagagaggctccatagcattagagttagactttgaaaccagaacttagagttgagtcttagctctgccttctttctagaaggggccatggacagattactttaacattctgggctgcagttttcttaggcacaaaatgggtgtagtgaaaagaaccttccttacagaattgatgagaagatgaaaagaaatgatgtacacaaaatgcctggctcagcacctgggatctagtaagccactcactggttactggcatcttgctaaccgacaaaagccaaacaaatcagatgaattcaacaaattgttcttaaatacctattgtggagccaagggtgttcacagaatatgatctccttttatcttcacctcaatgctgtgatgttgcttatccttctgagtttttatagataacacattgggactaagaaagagggaggaagtaatatggtcaaagccgctccttagaaagatttctctggcagctgtggggacagagtagagggaagacagaatgatggtgaggagacctgtcaatggcaacggttcagacaagttgtggggagggctcgaacaagggcagaagccaggctgcaggtggcatgaggcagtgtcacatcagtctcactcactactgtggccaagtctccttaaatgtttgctgagtgaatggatgactgaatggtgtctctgacagagacatatggatgaaggagatagaggtaaagtgcagggaggacccattgatgacaaaggggtttccagatcagtctgtcacggggagcaattcaagagaagaggtggggccgggcatggtggctcatgcctgtaatttcagcactttgggaggctgaggtgggcggatcacctgaggttgggagttcaagaccagcctgaccaacatggagaaaccccatctctactaaaaaatacaaaaaattagccaggcgtaatcccagctactccagaggctggggcaggagaattgcttgaacccgggagacagaggttgtggtgagccgagatggtgccgttgcactccagcctggacaacaagagcgaaactctgtctcaacttgagttgtagagcctggactagagccagcctcatgttccctttaccacttgcccttggagggagagatgcacaggttaagagcatcttattccgtcttttctttcttttctgggccagcacccttgaagcagcaggaagagtgtctagagccaggatgtgcacttccagatgcctgccttacccttcagctcccagctccgccttggtgtgaaaggaaaggccagctggcaccatcaatagctagcttgtcagcagcaaaacaaccatcccattgatcaaggaggctgattttctgccaaacactgggaaggcttcagtgcactttctggtcaatcccaactggattctgggatagcagttcctgctagcttcttccctccctgtttatttggttctataaatgtggagggcatccatttgaaatctgggtacccagatctggatgggctgtcaggctggactgaaggagtccacttcaaagatcatccttcatggctggagggaaactgaataaaaaagttgagatctggctgggtgcagtggctcacacctgtaatcccagtactttgggtggccaaggcaggggggatcacctgaggtcaggagttcaagaccagcctggccaacatggtgaaacctcatctctactaaaaatacaaaaattagctgggcatggtggcgcatgcggctgtaatcccagctactcaggagactgaggcaggagaatcacttgaacctgggaggtggaggttgcagtgagccgagatcagccgctgtcttccagcctgggtgacagagcgagactccatgtcaaaaaaaaaaaaaaaaaaaaagttgaggtctagtctctgatggaggctttggggcacaagacagggctcatgtggttggctgaccctccttctcagcccccatacttcctaggcatgtcgcttctgcttggatgtccagaaatttgtaaagcactctttcaggactgtgttcagacacgctagggaggcctgtgggatgctgctttcatgtgtgctcttggggtgcagcgatgggttggagggcggtgctgacacttcccctgatgaaatggcccccttgcctggagagagctcctttccttagctctggcaggggtatgtttttccatcctccttggtgtgaactcctggagttagttttgtgtcactttggatcttagtgaagcaatgtgcaaggggaagattaatggaaaaactctcctcccaactgcctggaaaatattttccccttttcagcatgaaaactaagaggagtgtcagctgaatggtctgaagagaagaggaagttgctgttccctgtgttagctcaggcccctgctctgccctttttgctgggtctctctcatgagtaggactttacttttttttctctaaggatctctgttggacctcagaggtatgaaatctgtcagcaactgacttctgttcagcgcccatcctgtgcacgtcctaggcaggctgctgtcttgacatctgatatgtgggacaaccctgcaaggaagattaaagtaactctacagataaggaaactgaggctcagggaattaattatcttcctggaggtcacatagcagctaaatgatgaagctgaaattcagatctattctctgtgggttcttcctgtaatgctgcatgatgtcagttcctggcatagcgcctggcacactgcaaagctcacatgtgttgagagaatgaaagaagaaaggagccagtgaatggaggcctcttcaggctcccatgagctgagttgacttcattttaacatttttacttcttgtgaggccttctcctcacaatgcctttatttcccaatcaggagaactgatgggaaaatgcttgttcctgcctgtgactttggttggtgatctagggaaggttgtgaggcaacaaggagggcttataagatagaatagtgaaaccacttagctgatagtgtgacctcatgaaggatacctaacatctctgaatcaacacaaaaggcaagagcagtcccttcaccttggtatttttgtaaagattaaatgaatgtgtgaatggatgcatatagtaaataaataattaaatgcaaagatttgatactagaggtatttagtaaagcctctggtacgtggtggtgcttattcatcattttgttttggtttattttaaaaactttaattcagggagtcttgtgcctgggggaggggaggcatctcgtgtatggacattttgcttggcggtgcatttgtccgggaattggtccacagcatttatttgattctcaaaaaagggttcatgacccccaaatgtttaagaaccactgcagttgaatttgatttttgacccatggttaaaagccactgaactaagaatatattgtgtctgcatgttcttggaattatgctgggggctattcaaagcaaaacaaagagaacatgaggaatctttgccttttcacaatttaaatatggtcaaacttgtaagtggaggcactgacagagttatgctcattgaaaggagatgatgcattgactgaattaggtacatatatagataaatatcagaaatgatgtgtgaggggagaatgcagaaaaatagttaaatattcactaatagtgttaaagcaatagatattagtttttctattttaacttttcttccaagagtatatctaatagccagctattattgcacacttactagcatcaggtagtgggttgtttgttctaaatgtttgatcctgtttaattcttatgaccacactatgaagtagatacaagcacagctatccctccatatccatggggaatttgttccagcactccccatggataccaaaatgtatgaacacccaagtaccttatgtaaaataacacagtatttgcatacaacctacatacatcctcctgtgtactttaaatcatctctagattacttataatacctaaaacaatgcttacatgaactcaacatagtattcaacatgcagcaaactcaagttttgctcttagaactttgcagaatttttttttccctaatattttccatctgtggttgattgaatccatggatgtaaaacccatggatgcagacggccaactgtattatctctattttatttctgaggaagctgtgattcagagaagttagatgacttgcctagggttacacagctagtcaatggaaattctcaaaatcatgagttgtcctgggacttatctttgaaaatgtctttattcctttggcatctttctcaacccagagtagtgagtgtatcagttaagatgcttttggctaaaagtaacagaaatcctcagctcaagctgtatcttaaaaacagggaattttattttgccatataacagagaacagaggttcagcggacttcaggtaggacatacgtaagctctgctccatttctttctagattctttccacctctttgtgctagcattgaccacagaggtgagcaagttgtctgaggcacacttagcaatgtctagacgaagagttggggatggtctcatcttgtgtctccataggaagaagaagatagttcccagatgactcaggaaaattttcctcgtattctgttgccagaacatggacacatacccattcctgaaccaataactgccgaggggtatgtgctgtggtttgaatgtgtttctcaaaaagcgtatgttgaaaacgtaattcccagtgtgacagtgttgggaggtggggcctggtaagagatgattaggccacgagggtggagtgaatggattaatgtagtcattacaggagtgggtttgttatagaaagggaagttcagcccctttttactctctctctctctctctttgcttttatgccatatgatgctttctgccatgttatgacacagcaagaaggcccttgtcagaagccttccccttgatcttggactttcaagtctccagaacagtgagaaataaatttctgttcattatagctataccagtctatggtattctcttatagcagcacaaaacagactaaacaggcttgggattgccatgacaggtttattaaccgggtaggggttgaatgaatattggagagtcaaccctacaaagtaggagaccttcaaaacaagaaatttggggggtgctgatctagttccttggcctttcctaaattgtgccacagtttcttcatttgtataacaactataatagcatctacctcatgagctgtcctaaggattaaatgagatgatatttgtccaggtgatatttgtttttctttttggtaaggtacccaaatgttaccacaaggaaactggatagtttgttaggatggttgaaagaagtgccctgtcctctctctgtgctaaggtgtgcatgtgactcaggataagtcagttagactctttttatggaaatttaaatgttcggtagagaggaaaaaacatttaaaatggttggagttgattcatcctgtggggggcaggctgaagaggccagaggccagcactcaatttcttctccgagagtcccagtactactgtgagtcctgtcctctcaccattctgtgggccttagcttgggttccctagaaacagagcctgagggaaattcttgtcacatgatttattgatgcccttgaaagaaatcataaaaaagtgagggaaacagaataggatgggggaaagagctgaataaagatgttatcttagctggagtctggccttagcctaagagtctgtgagttatgaattgcacaccagagtaagttctgccttcaggcaaagtggttggctttttaaatctcccatatcaatccaatgggaagtggagggtaatcccccagatgagtggactcttgttggcagagggcaatttgctggagaagggggcagttatgcactgtttgtaaccaatgctcacagcagctggtgggtgagtgcaccaaaggtaagaaggatcttggtggagcaccaatagcaactattaaaattcccagtgtctcctttcctgcctacattagccagaatctgtttctgtggcttgtgatcaaagtgccctgactaatgcattctgtaaaatgctggtagttattattattattgatacaattgcattattattatgagccactactccccaaatctgctgagagattatgtagcttctacagaatgagggatgaagagccttctataaagcttgtgtaaaatatataattggttcagcatcagactactctttttaagggaaaaattacagagaaagtatgaagtgtttggagtcggtttctcaaaattccactgatttttaattagaaagaaaaatagaactgtgaaaggagactgagtaagctttgactctgaaacaacccccctcaagtcccctctcatacataatttaattaaatgatagaatttattcttttaagtggagagttagtatctgtttgaattctgatcaaacagtggtaccctggacctcatgcccaaggaagacagaaattgaaatataaattttattttatttgatgcctgaggtacataatctactctgcaaatacgttatttgaaatttccaaagtttcccttaccagatattgcttttttcccctgtctgtgtaagtgcatttcattcaaaaacaccctacatgccaggttctctgctaagcaaatttgaagatgcatagttgaatcatgactcactgattcagcctttcatgagcttacaggctagaaaaggaagtataaacataaatacatatctcacagaagaatgcattacatctactactgaagagggatacagacagaaaacctacacaggttcagaggaggtttggaagacttccagtgaggttcttacgaagacatcaagtggtatctgcatggtactgtgcatggacaaatggctggagtttaggccttcagagatgggccattcacaggggcaagaacagcatcaacaaagacatcaaggcaggaaattgtgaatgtgtttgggaagaattaagtggcttggctcagcatgtacccctctgaatataaacatgacgccccgagacacctgtgagaatgtcttgctcatcaattgcaggtccagctgagagacacccatgtccactgcctgctgtctgttatgatggaggatgagcaaacatcaggcagggaagaacgcaggagtgtaatctctaggggcagtgggagggtggaagagtcatcagggtttttttctgaggaggtcatgaattgggcctatgatgcaggagcaaagtcaggggtgcttttaacaggagattttaagacccaggcaaagcggacagaaagatgctgggtattggaaactagtgagcatgatccggcatcctgataaactctcccagggccctttatgggagctcatacccccaggtgtcaaggtctaggataggcatgtagctacagaacagattttcatccactaaagctaagagagctctgtggtactgagacccatcaagtcagctcctcctgcaaccaacccagctgaccagcccagccttacctaaagatctatgaagtatcccaggggcttttctgttgtcagttgcttaaatggcacactttactatctgagcaggctatacagcctctctatatctcagtttctcacctgtaacgcaggatgaataacaagatctacttcatagaattgtgtgggtgaggcgagttaatacatagacacaacttagcatcgtgtgtgtcgatccttctatttatgcatcaactccaaattccagtggggcagctgcaagccagattgtcaagagcagggagtcagagcgatgggacacatctcccaggaaaggagcatcctggtaccattggagacacccagtaccacaggccagcctgccacctggcgctggagaacagagggcccctccccagcagagatctcagaccacaccaccatcatcacatggaaactcccatcttgaatccagggatggaattaatacgtgcacagggaaggaaaaaaatgtgagtctcttgccccccttttcagtaccatcacatccagggggctcttccctgcagcaccagctccttttcaaccatgcgaggaaatggaatggttttcttgaaagattttcttgaagaggaaaatctctttagaagagagatgatgaaacaatagatggggaagcatctgaagtggaaaggctttgggtagtaaaggatccaggtttccagatggtatccttggggctgctgggaccaacagagaggatatgaatgtgctgtcaaaggaggtttttctgtttgagcagctacaaagaggaaggcactagcatcactaatgggaagtgagaggaagcaagggggggcgcccagcgatgctttcagatgactgtcttattgactacggttgacaggattgcttgcggccccgagccttgaatcccaggatttcagaaatgcatgagctgggctggacactgacctacttcttatggtccattctcctcctgagatatttgtctgctcttgagctggcatattcctttccagagccctcgaggtaatagtgcataacgaaaaatgctcactaaataaaagactctctgttatttgctctctgttattataaggaattggtatttaaattttacatctcttctggcccactccatcttctcaaaggagaggcatgtaacgaggaaggccataccttcaggtgtggaaagcctgtctttgcgccagttgtcctggcataattattaacagtgtccactcccttttctctcccacaggcatcctagttcagtccataaattaaaagatcacctgtcttagtttgggttccctcagcagccgacagtgagacaaagattaaccacaagtgtggtcatgagctgtgtaactaccttaggtcaacaatgcagcatgtattgtagtagctgcggtaaggttgtagcacaatacgttatacatgtgtttgtggtggtgcatatgtaaacaaacctactgagctgccagtcatacaaaaggttagcgcatataattatgtataaaacataatactggataatgataataagtgactatgttactggcttatgtatttactatgctttactttttattgttattttagagtgtacactttctacttactgaaaaaaaaatctaactgtaaaacattctcaggcaggtccttcaggagctattctaggaaaagacattgttatcaccagagatgacacctccctgcatgctgttgcccctaaagatcttccaatgggacaagatgtggaggtgaaagacagtgacattgataattctgaccctgttgtaggcctaggctaatgtgtctgtgtgtctgagtttttaacaaaaaagctttaaaaatgaaaataaaataaaaatagaaaaagcttgtaaattaagatattagtcagttttcacaatcctataaagaacttccctgagactgggtaatgtataaaggaaagaggtttaattgactcacagttctgcatggctgggtaggcgtcaggaaacttataatcatgccagaagagaaagcaggcaccttcttcacaagacagcaggagagagaagaacgaagcaaaggggggaaaacccccttataaagccatcagatctcatgagaactcactatcacaagaacagcatgggggaaaccgcccccatgatccaatcacctccctccctcgacacatggggattagaggtccatctctgcacacgtggggattacaatttgagatgagatttgggtgggaacaagagccaaaccataccagatataaagaaataaaacatttttgtgcaactgtacaagacgtttgttttaagctagttattataagaatcagagttaagaaaagtaaaaagtttataaaataaaaaagttataatcagctaaggttaatttattattagaggacaaaaaatattttaaaataaatttagtgtagcctgagagtatagtgtttataaagcctgcagtggtgtacagtaatggcctaggcctttacattcactcacttgctgactcacccagaatcacttccagtcctgggagctccattcatcatgagtactttatacaggtgtaggatttttaattttttatactatatttttactgtaccttttctatgcttagatatgtttagatatacaaatacttaccactgtgttacaattgtctacagtattcagtacagtaacatgctgtacagggttgtagcctaggagcaataggctataccatataacctaggtatgtagcaggctacaccacctaggtttgtgtaagtgtacttcttgatgtttgcacaatgacaaaattgcctgattacacatttctcagaccatatccccatgattaatgtatctcatggctgtagtttatttgggaagtgcagtgaatatactacttggagactagagaaataagacaaggaaagaaacacagctaataaagagtatgctattaaaccagctaccccggtgcagaatggaagcttaatctgggggaaaattctgggaaatgatatgaaatgcatgcctagaattgtcttactccagggacagggcaaaggagttggggtatttctccaccaactcttgagtcaaagagctgctcctgagagctgttagttccctaccacttctggcctgcctcatgagcagaatggtcttttgtggttctgagaaaaaaactctctcaaacacagagaggcagattccacactggaaaatcagcaggggcccattggaaagtctgaggaatatggatgggcactgacaccatctgccacatcagcatgtctttaactatccttctgtctatcacttggctggcattctgccatctccaagttcaccaataaagtcttgctctgtaagtgcaataaactctcttcaactttctcaatggctttcttggttcttttcaccactactcaagctttccctcttcaaactctacatacctgacttttgtgaccctgttttttccctaattccttgatgctcctattgtctttgactaattgtgagcatttatcaaaggctttttctctttttcccttggtaattttctgtatccatgacatcaacagtaacctgcatgtagatggttcccaagttaatatttctcaaatccatgaacttatttaatctatataaaagctctttcacaccaaagtctttttaactctgagtctagtgctcttttcactacagttttatcagctgtgatttctctctggagacctatcttccacatcttggttgcctgctcagtgtctctattggtttgttctgctgtggtgttaaattcagtgtgctcaaaacttgctatttcagtttgaggatttaggtataccagtcctcagatctaaaaacactggtttcaaatttacaagaaaaaaaaaacccattaaaaagtgggcaaaggacatgaacagacacttcaaaagaagacatacatgtggccaaaaatcttatgaaaaaaagatcaacatcactgatcactagagacatgcaaatcaaaacctcagggaggcatcatctcacaccagtcagaatgatgttattaaaatatgctggtgaggttgaagagaaaaaggaatgcttatacactgttggtgggagtgtaagttagttcaactattgtggaagagagtgtggtgactccttaaagacctaaaatcagaaatatcatttgacccagcaatcccattactgggtatacccaaaggaatataaattgttcaattataaagacacatgctcacatatgttcactgcagcactattcacaatagcaaagacatggaatcaacccaaatgtccatcaatgatagactggataaaggaagttgatgcatatacacaatggaatgctatgcaaccataaaaagaatgagatcatatcctttgcagaagcatggatggagctggaggccattatccttagcaaactaacacaggaacagacaaccaaataccacatattcttacttacaagtgggagctaaatgataagaacacatggacacatagaggggaacaacacacactggggcctatcagagggtggaaggtgggaggatggagaagatcaggaaaaataactaacggggactaggattaatatctgggtgataaaataatcttaaaacaaacccccaagatgcaagtttacctatataacaaacctgcacatgtacccttgaacttaaaaaaaaatgagaacatagtttttaaaaattgtcccttaaagaagcttttgcctcatgccttcctgttttgattcatttagtagcttctgcctgagcagcttcccctctcctcttcacctattcccatagtcaagactatgtttgcaagtggcatgagccttacttgaccaccattagggaaaagaagaaaataattggctcagtggagtaacttgtagggaaagcagaggttcactgagcttgtgagaaaactggaaccaagttctccaatgtcatcagcactgtcttgctctatttctaatctcagctgccttttctcagcccaatctcctcttaaagcaggattcatgaccggcagtagcttttcctcacatctcatgcaagcaggacctcttcctctctgttagttccaagttgggtgtgtgtcttgtttttaagaattctaattgtctagaattggattctatgtctactctagtagctaaagtgcagaacgctaacattggcagcctcacccagaataatccccaatagttggaatgggaaggggcaatttccaaaagaaagggggatacatttccaaaagggtaagggagaagtgctgagctgatatggcaatttgtgttacgtaattttacctttttcggaaatcccaattcctccatgaagccttttctggtatcctagccctatgtattctttcccttgttagaataccatcgcatttcttgactgtgatacttatttgtcatttagtcttatcctgtcttaccccatctcttctgttattaaaaggcgttgctagtttatgatttatttctttatttttaatgattcacctatttagattattttctcattagcttggctattgtcaggctgtaggattgtgtcttagtttactttttatcctgtaagtgacccaagcatgagacttttcccagactgggcttgaaaacagttcgtctgtttgatttggttcctactgggctgtcatccatgttgaacacatatcaacctgggaggtctggtagagaaaaagtcctgtgctgagactcaggagacctggtttctgattctcacatgagccgtgagacgtaggccaaatcacaactctctctgttttatcgatttttccatctgtgaaatgatgacaaaaaaatatgccccaactcttaggattcttgtcagaacacactgggagcaataaaaagaaaagtgctatatacatgcaaggtatgtttattcatattgataattgatagagaaaactcagatgttcccagtaaggtatcattttcaagtacaactcttgctaccacgtttgcatttacacaattgtttccctccctagataaaaccacctatctgctggaaacatgaaccagtggttaagccaaccattaaattaacttataaaagctttgtggaactttaaagaaaatataatagtaaattggtttccaaaactttctaataggaaaactcatttctttggtcccacgtggcatcaaagtgccaaataggcaaaaaagccaaactgttagagtggctttttttttttttttttggttggttgtttaattttggtaatgaagtgttgatgtaatgttctttttaaacatcaaccttttctttctcctactgctaaagagtccagattctaattctcttcttttagtcaagctgcagaaaaccaattcaaatttactcactactttgtgtgtaccggatgcatgtaagggactggtcaatagggtttatagtggcaataagggtcagctgggtcaaaaggatcttaaggagcatccagtcaaatagggaagacaaatggtaaacaacccattctaattatatctacaattatgcatataacaattctctaaagcagtatatgagtcagggtgggttagccgatgtaacaaacagccccaatttttagtgtcttaacatagtaaaaggttatttcttactcatacaaagtctaatatacttgttcctggttggatggctttcttccaagtggggacacaagggtccaggcatattctgtcctgtgatgtcgctgtcttcaacttatggcctgtaaagtcaccatgaaaggggataatagcctgggcaaagcacacaggatacttagccgtcttaatctgatagtgacacacatgacctctgctcatattccatggccacatatgtccacctagtcacatggagcaactgagatcctgggcagctgcttctcagccacagtagtactattcaaaagggacacatctcttaggtggatgactagctgcctctgccacaagtagtcctgagaggtgaagccagctggacttcctgggtcgagcagggacttggagaacttttctgtctggctagaggattgaaaatgcaccaattagcgctctgtgcctagctaaaggattgtaaatacaccaatcagcactctgtaaaaacacaccaatcggtactctgtgtctagctaaaggattgtaaatgcaccaatcagcactctgtaaaaatgcaacaatcagcactctgtgtctagctaaaggattgtaaatgcaccaatcagcactctgtaaaatggaccaatcagcactctgtaaaatggaccaatcagcaggacatgggtggggccaattaagggaataaaagctggccaccccagccagcagcggcaacctgctcgggtctctttccatgctgtggaaactttgttctttcgctcttcatgataaatcttgttgctgctcactctttgggtctgcgctacctttatgagctgtaacactcactgtgagggtctgcggcttcattcctgaagtcagcgagaccacgagcccacctggaggaacaaataactccagacatgccacctttaagagctgtaacactcactgcgaaagtctgcggcttcactcctgaagtcagcgagaccacgaacccaccggaaagaagaaactccagacatatctgaacatctgaagaaacaaattccagacataccatctttaagagctgtaacactcactgcgaaggtccactgcttcattcttgaagtcagcgagaccaagaacccaccagaaggaataaattccggacacagtactatttttacaagtggcaaaattgaggggttaagtaacttacccaaggtcatacagctggtgtgttgaaaaaccagatttgaacccagtctgtttgccctaaagctcatgttctcctcactccatcacactaacttccttaccatggccgtgtgacaggctccaggccatgactgggctctgtctgcatgatctgccccttgaacccatttttcctggtttgtgccagtctggaaagctggtcctgctgctgccttaacttctggtctgatattcttcacagcccttggctgtgacttggggtcttgctagttttcctcaactctctcctccagatgcactcttagcactggacaaagtttccatcattgtgacacagaaaatcaagaaataggattagagcttgtacaactgctgtttgaagaaggtagcggcaatttgcctatataacttgaggcactttcagcaataaaaactagttgtatcatgttatggttccatttcttccaggctagtaaatggtcagtttcaaagaacagacagggctctaggaatttagatgtaagagacaattctgagtttgaaaaatggagccaattcattttgtgagcataaatatgtacatggggctccaatcagaagcaacaggacagatttgtataatgaactctccagctagcccatcctgattcatacactgttttaagttttggatggaccacagcaaagggctgtgctcacatttaccctgcctgtttcagatgtatggaacatcagccccatccatgaaaccctgattactttgaattccagtccctatggctacaaagcaaattaactgcaaacttagtttaaataaccatgtattatgctcatagatgtgtggaccaataattcaaactgatagggatggtttgtattattttttctaatttctggggtctcattgaaagactcaacagctgagggttgagatcatctgaaagcttattcactcacaagtctgatgattaataatggcattggttgggggtctcacttccccttcacatgggcctttggatatatctttctatgtgagctagttgggctttcttacaagcgtggtggctggattcccactatggacatcttgagagaaaaaagagagagtcaagcacaggtaggttgtcttttttcagctgtcctcagaattctggagcattgattctgccacattttattcattgaggcagtcacaaagttctccccaagtttaaggggagggaagatagactctgcctcttgatggggaatagcaatgtctggaagaatgggtaggatttgaaacattgctgtggccatatttggaaaatctaatttgccataccttgctttcattttgatccttagatctggcttaaatattagttgtcatatatttgatacccatgtgccaggtaccttattatatctaatcctgacctcaactcttcaaagtaggtcatgctatcccttttataaattaggaaactgagacccagagaagttaactaacttacccaaagacatggagctagcaaatgataaaattaagttgcaagaccaagcctgaaccactccacatctcatactttccccaacagttcctatatgattcccattgggaatgactcattcctttaatgaaaggaaagtttggcaggggaaggttggagtggtggagatggggtaaagggaagttcagacactttgagttaatggtaatttccatgaaggtgcttgttctaataatttccaccttcccgagtccacatatccttagagcccatcaagtcaagctgatgtaatttaaaaccctccctggtttccaaacagctgcaatatatttactttgattctccgccaagtataaaatattactcaaagaccacaggactgtataatgttaatgggcaatgaaatccacccttcttcaggtgggtcaaggagaaaccatggaaagattttattaggatgactaaagtaactctttatcatcttgatcattcaaatcaagatacttttttttcttttactgttttgtttgtttgtttgtttttttattcgagacggagtcttgctctgttgcccagactggagtgcagtggcgcaatcttggctcattgcaacgcctcctgggttcaagtgattctcctgccttagcctcccaagtagctgggattacagacatgcgccaccatacccggctaatttttgtgtttttagtagagatggggtttcaccacgttggccaggatggtcttgaacttctgaccttgtgatccacccacctaggccttccaaagtgctgggattacaggtgtgagccactgtgcccagcctaaatcaagaacttttgagagtgaaaagtgatgctgttaataattatgctgaagaaggcatgtgctgaagtgttctatatcttgatctggagaatagttacatgagtgtgtacatatttaaaaaatcgttgtgctgtactcttaaaaggtatatactttactgatgttaagttatacctcaaccacaatatcaatatagttataaaataatgataattatgccaggacaatgagtgtaaacaacttctctctcgggcaaatagggacatatagtcatcctagtcatgaccagttcccaagctggcctcactgggggtgaacaagaaggtgtttatggtcagaaatgattgaatttcaaaatcaatatccaataaagttttatcttggctgaagccaacatccccttttctagacttacactctacattttgtgggatggagtgatggtgaaggtggggaggaaatggtggtggtgacatgttgtgaatagaggtggggagggtgatgctgttgttagtggttgtattagtttgttctcatgctgctaataaagacatacctgagactgggcaatttataaaggaaagaggtttagtggactcacagttccacatggctggagaggcctcacaatcatctcagaaggcaaaggagaagcaaaggcatgtcttacatggtggcaggcaagagagcttgtgcaagagaactctcatttataaaaccatcagatcttgtgagacttatttgctaccatgagaacagtgtgggggaatgaatgatttcattcaatccagaaactgaatctttcatgattcaattatctccacctggtcctgcccttgacacgtggggattattacaattcaaagtgagatttaggtgggaacacagccaaaccatatcattccacccctcgtctttcccaaatctcatgtcctcacatttcaaaaacaatcatgccttcccagcagtcccccaaagtcctaactcatttcagcattaactcaaaagtccacagtccaaagtcttatctgagtcaaggcaagtcccttccacctatgagcctgtaaaatcaaaagcaagttagttacttcctacatacaatgggggaacaggcattgggtaaacacacatgttccaaatgggagaaaatggccaaaagcaagggctacaggccccatgcaagtccaaaatccaatagggcagtcatgaaacctcaaagttccaaaatgatttcctttgacttcatgtctcacatccaggacacactgatgcaagaggtgtgctcctacagccttgggcagctctgcccctgtggctttgcatacatcctctgaaatttaggcagaggttcccaaaccttaattcttgacttctctgcaccatgtggaagctgccacagcttgaggcttgcaccctctgaagccacagcccaagttgtaccttggccccttttagccatggctgaagcggctgggaggcagggcaccaagtctctaagttgcacagagcaggggggccctggacccagcccatgaaaccattttttcctcctaggcctcccggcctgtgatgggaggggctgctgtgaaggtctctgacatgccctggagacatttcccccattgtcttggcacctaacatttgggtccctgtaattaggcaaatttctgcaactggcttcaatttctcatcagaaaaaaggtttttctctttgtatcacattgtcagtctgcaatttttcgaactttaatttctgcttcccttttaaaaataagttccaattccaaattttatctttgtgaatacataaaactgaatgctttaacagcacccaagttacctcttgaacatttttactgcttggaaatttctcccaccagatgccctaaattgtctctctgaagttcaaagttccacaaatctctagggcagaagcaaaatgctgtcagtctctttgctaaaacatagcaagaatcacctttgctccagttcccaacaagttcctcatcttcatctgagaccacctcaacctggacttcattgtcagcattttggttaaagccattcaacaagtctctaggaagttccaaactttcccacatcttcctgtcctcttctgagccctccaaactgttctagcctctgccagttacccagttccaaagttgcttccacatttttgggtaccccactctaccagtaccaatttactgtattagtctgatctcatgcttctaataaagacatatctgagactgggtaatttataaagaaaagagatttaatggattcacagttccatatggctggggaggcctcacaatcatggtggaaggcaaaggagatacaaaggcacgtcttacatggtgagaacagtatgggagaaactgctcccattattcaattatcttcacctggccctgcccttgacacatggggattattacaattcgaggtgagatttgggtggggacatagccaaaccatatcggtgtgatgttgctgttgagagtgatggtggcaatggcagcagtggtgggtggtgttgttagtgatcgtggtaatatatgtatatatttttttagagacaaggtcttgctctgttgcccaggttgaagtgcagtgtcacaatcatagcttgctgtagcctccaactcctggactcaaatgatccccctgcctcagcctcccaaatgctgggattacaagcatgagccacttaacctggctgatggtgttagtactgatgatggtgttagagtgatgtgatggtggttctggcaatgatgagctgtgtgatgaaggtggtgatggtggtggtggtgatggtaggtggtatgattgtggtggaggggagtgaagatggtggtggtgattagtggtgatgcagtggtgatagtaggaacactatatggtatggcaatggtggcggaagtgttggcggtaggttgtgtgatggaagtggaggtggtggtggtggtggtgctgatcatggctggtggtgagatggtgtggtggaggtggtagttttggtggtgatgatggttggggctgatgttggccatggttggtagtggtgaaacccaatcaatcctttctcttctaggagatccctgggattcttttataacttatgcagatcttcctcagacctttgcatgccacaggagaaacaacttccctagtcaaataaaaggtatttttccccatggcagggccttcccaagcttacatcttcctagcaaggagttgccctgaagatgtgctcaattgtgacttgacagcttcttttgctaaagaagaaggggaaaaaatccctgattgctacttcactacccaatttttggttcactacaatcaactatatacagttttcattctattttatggactcagacatcccttgtcaaacccatacttgtcctaataaagtccctagtgagtgaacctcttcaggtattaaagatagggggcccaggcaggatgaaactaatggacaactatgttgtaaggagtcttgtgccttatcaacctccctcagcacccccagattgaacctgcataacagaatctgttttgtatctctggctgtaactcccatttgctatgtgctaggcaccatgctaagtgcttcacataaatgatcccagtgtaattcttagcaaaaatggtgtgagggaagcaatattattcctactataaatttgaagaggccaaaactcagagaggggaagctctcacagctgacaagtgtgtaagtaatgagtgtgtgtaaggaacggccatacacatgcttatcgtggctcacctcattgttacaattcagttgatcacagattgaaatgcctaacaaggacatcttctttttctttttctttctcttcttctttctttttttttttttgagacatggtctcactcttgccacctaagctggagtgcagtggcatgatctcagctcactgcagcctcaacttcctgtgatcaggtctcgcacctcagaatcctgagtagctggaaccacaggcacacaccaccacacctggatacttttttgtaattttttagtagagatggggtttcatcatgttgcccaggctggtctcgaactcctgggctcaagtgatccacccaccttggcctcccaaattgttgggattataggcgtgaggcaccacacctggcctctttttttttttttttaaattaacttttaagttcaggggtacatatgcaggttggttatataggtaaacttgtgttgtggggtttgttgtacagattattttgtcacccaggtattcagcttagtacccattagttatttttcctgaacttctccctcctcccacccttcaccctttgataggccccagtgtgtatttttctcctctatgtgtccatgtgttctcctcatttagctcccagttataagtgagaacatgtggtatttggttttctgttcctgcattagtttgctaaggataatgacctccagctccatccatgttcctgcaaaggacataatcttgtggtttttttatggctgcatagtattccatggtatatatatgtaccacactttttttgtctgtctaccgttgatgggcatttaggttgattttatgtctttgctattgtgaatagtgtgctacaatgaacataagcatgcatgtttctttatgacagaatgatttatatccctttgagtatatacctagtaatggaattgctgagtcaagtggtatttccgtttttaggtctttgaggaattgccacattgtcttccacatggctgaactatttatactcccaccaacagtgtataagcgtttctttttctccacaacctcgccagcacctgttattttttaacattttaataatagccattctgactggtatgagatggtatctcattgttgttttgatttacatttctccaatgatcagtcatgttgagcattttttcatgtgattgctggccacatgtatgtcttctttttaaatgtatctattcatgtcctttgcccactttttaatgagtttttttttcttgtacacttaaagttccttataaatgctggatattagacctttgtcagatgcctagtttgcaaaaatgttctcccattctgtaggttgtctttcactcttaatcctttcttttgctgtgcagaagctctttggcttaattagatctcatttgtcaatctttgcttttgttgcaattacttttggtgtcttcgtcatgtaatctttgcctgttcccacgtccagaattgttttgcaacaaggacgtttttaacctagccatggtgctggagcaataattgatttcatttgtccaaagacctggtgtgcttgcaggggccccttagaaaggaaacacacagaaagacaaggagctatcactattaatgtgagttttcaatgtcctgttaaagccaacactgaatttctgaccaaaaaaataaagcggatatttctgtgactgaaatcaagtcattcaggaactgttcccaataaaaagctcctattccttttgatctgggattgtccctccagaataatacagaggaaaggctggtttggaaaaagtatgtttttctatgaattttattttaaaacaaatatttaaagagctttctttttgcaacatattttgttaaaagagcttctctctcataacaaagccacaggtcttcctctgagagctgagaaaaggaggcgtctgccaagtctggtggcttggagccagttcatctcgaagcaagggctgatgggtagagcgagacacacaatgggccagttttagaaaactgggaaacatggggctgtttcgcccactcccaggttagcagccgtgtgggtttggttcacgcttcaaggcagggcaacagggatggccatagcacctttggggtgaaaccaaatattagacagcctgaccccaaaggaaacctgaagcaagttgcaaattatattgggaaacagtgggtgatggggagcaataaaaggaaagagctcttgcagatgcagccacaggacctgagggtgatgttgaaccgactcctgcaagccctgtaatccaggccgccaagctaagaaaaatcgcagccagagaccaaggagttgcctctaaatgccacttgctttctggtactacaagcaagttgtacctatcattatcctccgggaaaacgccaggggaagctgtaatagtccctgcagggctatgcaaacgcctgcacctcagcattttctgatggtcgtgcctgccaatgattttatgaggaggaacatggagaggggaaggtgcaggaagggattggctctgaaccccaaggcctctgaaagcagacggccaggagggacccggagtgttggaggctttctgcaaggcctccatgggtctcttcttcctgtgagcacttggtgcctccttctccctctcaaggagaggaaggagacagtggggacagagttctagggaccttcccaagtcttgttggccctgggagaattgagaaggtcccgaggagccaggaggcaggagggggcaggggctgtttccttagtaacccctctgttgtggcaacagcaggacagtctctctgcctttatgtttccctatagacctgtggcaagcccttcccagtgtgccagtggaaactgcactaatgatttggttttcccaaagatttcaccatcagtctctcttgggctggtaagcaaagggcaggttggacctgacttgatgataggcaccttaggtgccagaatgaaggtaccaaaaacatgggaaaggaagatatggagtacatttcattgccaccaaaacatggcagggagccttgcatccttaggccattttactgccactttttcacaccatactatactttatggcagaaaagtattcaaccctgttgatcttcctccatatgtcagtcctggaattattctttcacttattgattcattcaacaattattgatggattgcctgggaacttgctagatgctagggatatcatatcataaaaactaatatttattgggtacattattatccttatgctgcagataggaaaactgaggaacagagaggcgctatggcagggaccttgtagatctgtcctctgttcttgggagcttatattttggtagcaaagatggacatcaaacaaatgattacacaactatttaattatcattgtgatgaatgttataaaggagatgggcgtttgccacggtcttgggaaaagatgtgaaaagggactgggaaatagcaagaagaactgaagacgagtcttttgaggagtttttttctgaagaatccagagacaaggccatgaatgggggaaagcatgagaggcggtgaggtcttgaagttccaggaccacttacaggtgcccgcggtacctctcttgctccagcctagtactggccttgcccaaagacgatgaaataaagaagttttcctgggaacactggagtgtatgagtttgatgttaagattgtccaaagtgttaaggataagaaataattgcagtggtgactaccttgagaaggtgagggggaggtattggctgtatatgggaacagcaatacttcatcattttaatggagggaacgtggaagagacagatgcagacaaattgggagatttggtggtggaaagatggaagagtttctgtctgattgctttttctattttctcagtaaaatatcaggcaagatactcatctgggagcgaagcaagaggaagggatgtgggcagtttgaggacagaaaagaaagctcgcaatggttgcattgaggagtggtggggcatgccctggcagtgtagcaggctctccaggcagggcccccttaagacttgtggtcatcatgaattaagtgtgagaccagctggcattttttgtgagaccagttatgcatttttctccaacaggaatctgctactcaggtggaggtatggagtgggtggatggttgggcttaatctgaattgagattgaatcaggtgagcatatgagagaaagagagaggggtgagggggtggggagattgctgggcagggaatggaacgatgaggggaaaaggagggttaggactgaagggggctaatggataaggaaacagtggcttctggattgaaggtctctgtgaagatgcaggcttattgggttggagtgggctgtctgagtagagttagcagaaagttttctgaattgtgcttttattagtggtgacaaggtcaggagaatgacaatggtgaggatagctggggggcattggaaggaaactgaaatggaggtgaagaagtgaaagaacagaggagccaagtgttgcgtgagtcattgccaagaagggtttcagagccagggtgaagagaaaaatagggagtcaggtgccagaaacttgcatgattcaggggatcacttaagggttgttagaggacaggaccagaaatgagttggagtggtctagttcagaagcatgaacttcagagtagctggggattttgaagagagaatgttggaaaatgtcttggaagtagcaatgggaagcaaggagaccatctgtgagagaacaaaagaggtgccacttggtgggctgaagggaggtggtgtcttcagggcagacttaagctccagagttagggcaagagccttcatgaaggctcagagaagatggcggggctccagaaacttttggtgatggcttaacatgggctccaaggggctcagtggaaggacttgagggcagagagggatagaagattgagttggtgtacacacagagcagaagagagaaagtggcctcggaagggataagagttgatctgagagactgagacatctgatagtctgaaaaatggaggcaaactttttgggggtggatggggaagattgctaataactctgccagtaataacttatatattaaaaaataatcatttgatcacaaatactgttagaaaacatcatgtctcgaactcaccttgggttatagctctcttaaattgttcagctgtgccctttttgtggacttcaccaaattgtcatttgattccttgacctctgcccctcccaatctgacaccatcaaggtaagcatcagaaatgagcagagagcattggatttgtggctctgtgttgaagttacttcatccagggcgtgactctctctcaatatccactagacacatcagcctggatcttctggtcatgttgctaaccagaagtagagttggagttccagaggaagagctggtggaaattcatctgatcagagcagtcaaggccatgccccacttctccttactcagccattcccctcctcccacccaagttcattcttccaaaatatctttccctaataagcaagagaggaagaagtggaggaattttaattcaagatcccaagcacatttttatgattctataattcttcctccttgtctcaaatcagcccatttatcttgggggcagggagctctgtcctgcagtgaaaagattcatgttggaagtgtgaggggaagagacctgacacaaaccacagtgaggttttccggggcagcagcaggtatactatggcagacagctttgtgagggactctgcactactgccaacttagtaacaaaaataatgcttatgaaggaaaatagataaagtcatggaaaccctaagtgcaatagaaacacaaggatacaacaagctgggtccagaagtagtgcccaaggccatcttagcaccctcagagccttccaccagcagctatttgttgagagtccataagaaacagagtacaaagatgagtgcagtatgcatgttccttgaatgaatgtcttgaagggacacatttgcagagtccttcaattttttaaatgccatcaactagagtgaacctagtgagtggttacccctggtatttaagagtacacacacgtgttcatgtacacacacccctgcccccatacatactttcttgtcaaagcactagaggaaaaccctgccaaatctgtgactcatttagcctgaactcttggtctaatcatagcttggtttttggatgaaatgtaaacttatttgctggaatatgatcagacacttctgggtttgatattctgtaactttaacagcaaattctgagtttagtgtgtgtggaaggaggagggagaatctgagaggagggaaactggttttaataatcttacttatctttagcaacttgcagcttataaaggtctttcatccagggttgtcatttgaccttccgaacatccctattggataggtaatttcacatcatctttatggacagagaaactgagatgccaagagtgtaaatccctgcagatccagggcaaggctgaggtctttaggctcattgactttctccttctttacccttaataatgaaaaagtcaggtacaatgaattctttaaaaacagtaaccaaaacttgtacctggagaaatgccacagaagggtatgcctgagtcaatgaattttacctaagccattttacacaaatgtcattgccctttgctggagactctcatttgattctagaaagcatgtaaacaacaggctatggatctgagccagatgctcagcagatcctataagagacttcattttccagagcattctaagaaggggtcaattgctaaatgcatgaagaaaccaacttaaatcagcagaaacagactctaaatcttaagtcttccaatcaagtggctgtttctgccaattgtgcccagaccaccacccttcagatgaacccatgtgcctcttcacatagcccatccttcggaattgtccccaattctcggggcgaggaggtagcatgccagttcctccccatggttaagggcacacctgagtgctctcagctgtccatttggcttcccaagacagttcaaccttttggctgcacagaccttgccacgggccatcctggaactgactgatcgtggatacaggcaagtcttgctatggattggaagtaatttaaattaaaagctgccctgtgggggaaaaccctatgattcctccctgaatgaaaagcatcttttaaatctgtgacttcattctcagtgactggctttatacttttcttcattctctttgatctgagatctagggagtagcacaccctcatatctgcattctaatgataggaagtgtggaaggggtaaagaggagacagggaaggactaggcagatggctccagacaaatggttgggttttgggggagctggagtggagatcaggacctgaggctgaggcccatgatggaggctcaatgctggaggaagccccacagaggcaagggtggcactcagatgcccagggctcacaccaacaccaggccagggagtgtgcagcgatactgcttggactcacctggtggtcgttgggaagctgctgacaccctggttcccatggctggatgggagttggcctgctgatggttggtctggaattctagtggctgaatggggctgggtagaggaaagggctgagaaatttagaagataaaataaccatctcacttctctagaagtacctggtggtgttataacagcaggctctgcctggccctgctttctcaaagagtgcagggtaaagttgtcttccagggatggggctgacacagctgcctggaagaatgactgcaggagtagggaaggagacagctgggtggtacagatagggcagggaatcttggttagacagggacagacagtagcttttcctctccagcaattgttatgctcattggctatgatcaactctggggcaggaaaaatgtaatatggagttgccgaaatgcagagctcatggaacagacagacagcaataaaatcttctggggtatagggaggaacatggtagctgaatttccatggtaactggttccatatgggagggggttcagaaggccaacatccagattttcaagcagttcaggccacctagacgctccttccattaaaatagctgggagcccagcagtcctggttctttgctctcaagctccactccactcaggctggtgaccacatgacaccgcaacccgtctgccttcagacctgcctccagctccacctgccgctgcctgcctttttctcattccatctccatctccagggtggcccatctacaaggctcacctcgagcccctatctccttttacaaactatctgcctcagtttcatatttttacccatcattatgtgggtaaaaattcttatgtactttattgggagaggaaaaatgaggcaaagtgtatgaaaatgcccattaaacactaaagggctataaactatgagaaagttacattttattaatagtcattatcacaacaagaatatattctattttatgtaataatatgaataatgtagatttatattattttgtaacaatgtttgacttgcattaaccttgtcttctcagccagctggtgaactccttgagggaagggattctgtcttgtgttagcaaacattgttacttctaccaacacattgctgactaaaggtaaatgccagattggttgattgaatgatttctgcttgatcagaatagcccacttttcggataagagagagaacaggagcccaggaaattcctaacaatattattcaggaggctggtttgttctcctaacaatgtaactactggtaatgtgattaccctctgattcccctacataagaaatcccagcctggaatccagtgtggaggcttggttccagaagccggtgtctcaaaagagcgaggtggaacattatgatcttttacgatccaacttcagaagtcacatagcatcactctgcatagtctactggttgaggcagtcacaaagttccacccagcccagtgcaagggaacatagaccctccctccccatccacatttcttgttgaaggtgggaagtggcaaggctctagaaaatagttcggcaaactgtttcttaaagagaaggtcagtaaatattttagacttgcatgccatacagtctcttgcaaactattcaactctgctgttatagcatgaaagaagccatagacaaaataggcatggccatgttccaataaaactttaattctaaaaacgggcagctggttcccagaccatagtttgccagcccctgttatagaagaatatgtacaatgaaagatgttgtattttaaaaaatacaatctaccctctgctcagagagaaataattcttttataacatatgaatgccacaggtattaaaaaattcctctaagtcagagatgcggctgcctcacagaaccttgggatgcttaaatgacttttcaccattttaccatgtcaaggagtcatcacaagtccagctgaaagctttttaagccaatgaaacctttctcccattccatttcccactcccttcctgtcaccttattatcctagaacattatcaggtgagaatgaagaagcctatgccacctttactcccagcgtggcaacctttgtctttaggcaccccaggagtctgctctttctctctggggctcctagcatcctatgaccttcatctgccagccaagaaccctggttctggaatttgttcaacatcttggcaccagcaggattgcttacgccatcccatgagtatagaatcagacaaataccaaaactgcagaaaggtaaaagttaaaaatatatgtacatacacgcacacacacatatatattatattatatatatataatatatatatataatttttttttttttgaaatggagtctcactcttgttgtccaggctggagtgcagtggtgtgatcttggctcactgcaacctctgcctcccaagctcaagtgattctcctgcctcagcctctccagtagctgggattacaggcacatgccaccatgcctggctaatttttgtatttttattagagatggggtttctccatgttggtgaggctggtcttgagcttctgacctcaagtgatctgcccacctcggcctcccaaagtgctgggattacaggcgtgagccaccgcgcccagccgtaaaagttaaatatttaaaggctaaaaagcaatgctggctgtcactagcttgtcagggaatgtaaggtgttagttgcaggtcatcttgtctaacttagaaaagtggcaagacagtggccaatgcaggagccttcaggatcctctgctaagttcctggctggattgccatagctccctgtggtttgccagtgctgaatgctcagctctgaccgtcgcttcagttccctccatctgtttaaaatgctgcttcattctgttttccatattcttattctcccatcctttctccctttaatctcagtgtgtgcgcacgtacacacacacacacacacacacacacacactctttctcttttaacacatctcttacacagaatgaatagagccagaggccttatgactacagttaaacccacatgaacaggcaggaactgattttgtttttttttaaagccctgaggttgagattgttttattgcttaacacagaccttcagtgatgcagtgtgggcaggggtcctggaaaaccctctgaccactgtatgtttgagatgggccacaggagaaggaatgttggaaccacaactcccctacaaacttggtagtttatcttcttccctgtgatttgtcttttcccttcccgcagaagttttctgtgacagactgatttccttattgaattaattacatttttctccatctgattttgctgggaaattatatgcagaatggaaaatatcatgcagttccttcctacataagcctgtgtgtgaatggatccagcaagaatgaaaacatttagctatttttcctgtgggctcttggtacagttttttttttttttttttttttttaataggtactggggtttggatctagaacacaaatcaattgcaaaccagtgtaccatggcgtccttgtagcaaccatgccccatatcctgtctgtggcctatttccccgttagatttcacttatagatggcaatgacttattgaagcatttgacttaagcctgagaagcaggcagtgttgttggactggaaggaaaggcaccattgtttgggggcacaatggctgggatctggcatgatgtggaagaaggtcagagccatagttcctcttccattctgttctgtgccctcgagggataccgttacctggtgcagcgggaagcccacacacagcgggagggccggtcacaatgatgctctgctctagtggctggaggaaggccccaaaggctccatgctgtgccatcaactctttaattaccaaattaagggaggagtggtccagggtgtcttaggggagaactgaggtttcctggatggtggtggggatcttagcaactggggttagtgatgacttaccaaccaatatagaagcatttcaatattttaacaactagtttggctgtattattttgtttcacctgaataatagttctgcttggacatgccttgtgtatcaggccagggtcagtggttatgaattttcctgctcaccatgtggtaatccccagatcatcctgaaagctccaacaaatcacttaggctcagttactaagatgcacccaaagccaaaccaagaagtgcaaaacacaaagatggtggaaaattgatctggatagcagtggcaagaactgcccatttccctgagcacagtggtggcatctagtagtagagggggcagctgtgttgagtgtctaccgtgtgacagatgtggttctaaccattctcacatctgttatgtcttcaggacctgcagttagtgaaactaaatctgaatccttgtaagttcctcagtgtctataagcctctgaaattttaacacaataatagtacttactgcatggaaagtcacaagtagaaatgaaaattttagccaaaaggaaagctgagtctgggtccttccactgggtagtcaaaatgtcccacaggacttgtcagggccctgatttgattgtagttgatatcgtttggctgtgtccccacccaaatctcaactagaattgtatctcctggaattcctacatgttggggagggacccaggaggaggtcattgaattatgggggccagtctttcccctgctattctcgtgatagtgaataagtcccatgagatctgatgagtttatcaaggtttctgcttttgtgtcttcctcattttctcttgccgctgccatgtaagaagtgcctttggggccgggtgcagtggctcacacctgtaatcccagaactttgggagactgaggcgggtggaccacctgaggtcaggagttcgagaccagcatggccaacatgctgaaaccccatctctactaaaaatataaaaattagccaggcatggtggtgcacacctgtaatcccagctacttgggaggctgaggcagaagaactgcttgaacctgggaggtggaggttgcagtgagccgagctctcaccattgcactccagcctgggcaacaagagtgagactccatctcaaaaaaaaaaaaaaaaaaaaaaaaaagaagtgcctttggcctcctgacatgattctgaggcctccccagccatgtggaactctaagtccaattgaacctctttttcttcccagtcttgagtatgtctttatcagctgtgtgaaaacaaactgatacactagttatgtaatctaagtccaggaacagggagttcaggagaggagacatcactctgcaagtactggaaaggggtgttatctttaagataatgaagtagcattctggagtttatcaatatcctttgagtttgattagtgatatggtttgaatgtgtctcccaaagttgatgtgttgaagacttgatccccactgtggtactgctgggaggtggggcctaatggaaggtgtttgggatatggggacatcaccctcataaatggattaatgctatcatctcaggagtaggttccctataaaaggacacgtttggcacctcttgttctctctctctcccctcccctctttttacttttccaccatgggatgatacagcaagaaagctttcatcagatgccagccctttgacttggacttcccagcctcccaaatcatgagccaatatatttctcctcattataaattatccagtatgtggtattctgttgtaacagcataaaacacactaagtaagaaccaatttcctagcccatgattatctccaggtgtttcaacaaaattacatttctgaacctgcaaagtttgtaaccaatgccacagggtaactttgtgaaggtgtggaccattttctgaaaccaacttaaggcaccagctcatattggaaggtatgtctctacctccctcataccttctcttccctcttcctcctctcttgttccacttgtgctttttcttctttcttcttcattttcacaatggactgactgtttgtatccccttcaaattcatatgttgaaatcctaaccctcagtgtgatgatatttggagggggtgcctttgggaggtacttaggtcatgagagtagagctctcatgaataggatcttataaaagagaccccagagagttatcttgtcctctgtctgccttatgaggtgatatggtttggctctgtgtccccacccaaatctcatcttgtagctcccataattcccacatgttgtgggagggacccgatgggagatgattgaatcatgggggcaggtctttcctgtgctgttctcacgatagggaatgggactcatgagatctgatggttttgcaaacgggagtttctgtgcacaagctctctctttgccggctgccatccacgtaagatgtgacttgctcctccttgccttccaccatgattgtgaggcctccccagccatgtggaactgtaagtccagtaaaactctttcttttttaaattgcccagtcttgggtatgtctttatcagcagtgtgaaaacgaactaatacataaggatacaataagaagtcagcagtctgcaacctggaggagggctctcaccagaacctcaccatgctggcaccctgatattggatttctcacctccaggactgtgagaaataaatttctgttgtttatatgtcactaaatctatggtactttgttagagcagctcaaactgactaagacaatcctctttattgctccatcctttttccccttttgctctgttttatttatcaatgtgaacctattattaatatcttctcttcctctgcctcatccttctattcactctctttttccttattcttcttcttctttttttttttttttttttttttttgaggcagggtctcattctgtcacccaggctggagtgcagtggcacaatcttggctcaccacaccctcgacctccagggctcaagtgatctctcaacctcagctaatttttgtatgttttgtagagatgaaatttcaccatgttgctcacgctggtctcaaactcctgagctcaagtgatccactcacctcagcctcccacagtgctgggattacttcttcaagtgttttattactttagatgagctcaaatgtaatatctcaagtggtggcaatcatatttaagctacacagaagcaatttgataaggggaattcaccccaactccaccagcggaggccctctgattcctctggagacagtgtagaaacaccatggcatcagagagtaagaaactcaacaagtgtccagcacaggcctgaggagagacctgggtctcaagcaccacactgcattatcactcattagatctccctcccaggctggatgaaatagccgtcaacagttttcatttttgacaatgaaatgattccaaatttgccaatcttacaacaaatgtaattgctgaaagacatcagtattgggaaagtagaagccctggtcttgggatagtaatcatccaatccttggcatagggagattctctctgctgaaaatgtccaggtttcatttacatcattgtctccctgcatctgttcatcttggagcaccaacctatttgggttcttgaaagtcagcaagatcaaagaccactcactgatcagctaggtcatcctggaagcctcatggtagccagcaggcaggcctgcaggcagtgtggcccccttcccttttgtgttcagcatcccaatgaggatgtgtataattgcaacaatctggaggcagtaaaaatactcaggattaagcaaactgtgctagggatggcctgagttcacaggtggtccccaaagaagagcagatggagaggtgttttgtgaacaagaaatttgactgttatgacaactgcatagcagcatgaaagtgtctgacatggtgttaacagacaaaatgataatgacacataattaaatatcactaaattgtatgtaggcatcaggatcaagattggaagaatggagatgtgaaaacataggcagttgattattacattctgagtgaaaatgttttaaaaactttaaattttgtattacccagttttcactattataatgctacatgacaaataacccccagtctcttaatagcttataacaaccaatgtttatttcttgccaactggtaggcaggttgatggtaggccagatgtgggtcagcatgactagactgtatccaagactttaagttagattcaggtctgctccatgtatcttccttctgagactgactacagagaccaaaatgacctggggcataactttctattagcagacatcccaagattaagaggggcaaatgaagacatgtgatatctcttaaggtgtcatcctggaactggagtgtgtcacttctgctcacattccactggccaaagccagatatgaccaagcccattatcagtgggatgaggaagagtactccactcagggaaattgttgaattgcgtcccctaaacttcacatgttgaagtccttacccctagtacctcatgatatgaccttgtttggagatagaatctttacagagataatcaacttaaaaagaggttatcaaagtaggcccaatccaacatgactggtgtccttataaaatgaagaaatttggacatagagacacaaagcaagaaaatgtgaagacttaagggggagatggtcatttacaagtcaaagagagaggcctggattctcttctcacagccctcaggagaaaccaaccccatcaacatcttgatctcagacttccagcctttaaagctgtgagaaaataaatttcttttgtttaagtcactatagcaaactaatactgaaggttggcaagagcaggaagggaaggaagaattaaggacagataacgcaatctatgatgatgttattctgctaatcatttttaaaattaacatagtgggccaggcgtggtggctcacgcctgtaatcccagcactgcaggaggctgaggcaggcagatcacctgaggtcgggagtttgagaccaggttgaccaacatggagaaaccccgtctctactaaaaatacaaaattagccgagcgaggtggcgcatgcctgtaatcccagctactcgggaggctgaaactctgtctcaataaaaaataaataaatttaacatagtgaagaatccatggaaagttcttttctcattaataataagtccataacaatcacaacagcaacaattaatcaaataaaactcaagcactactatattccaggcagtgttctaagctctttatatataaaaatttatttaatacttaaaatagtgtctatgaggtagaactattgttatgtccaacttaaaagctgaagaagttgagaccctgttactggtagttaggcatgagtagggcaggacagggctctccgcctaccaccctctggaaatgtcaggtgatggtttggcaattatctcattgcctctctaaaaatgacagttcagcagcaccattgacaggccatttcctgatgctccacacctgttaacatcaaaatgtcaattgaatgcaggcccagggagaaatagcactcgaatataacattttctttttttcttctcagcaaggcaatgtacttctatagaagggtgcaccctcacagatggagcaatggtgagcgcacacctggacaagggaggggaaggggttcttactcctgacgcacgtggcacctgctgccctgtccttcccctattggctggggttagactgcacaggctaaactaattccgattggctaatttaaagagagtgatggggtgagtggtttggcaggaaaaatggttatggcagagcaggaaatcaaaatgagtcaggatggagaatgagtcagggagaagcaggtaatcggaatgagtcagagtggagcaggtgattggaatgattcagggtggggcagttgatgagaatgagtctgggcagagcaggtaatcggagtgagtcagggtggagcaggtgatcgaaaaaggttgctttatgaggaagttaagtttaaaagtagaaggcaaagaactgaacatactgacatattgagtctttgaagataaatttagaactcgtatctaacagcatgcatgttaagagacaaaaacggtgaagtatgatcttttgggggcacatgccaccagaaaaggaaagaaagcttcagagggacacgtgggtaactccctaagcactgcgggtgctcaattcccaagggtaagaaagcactgggcatgcggaaaattcactctaagggagggatcatgggaaagaggcgagactaggatcaaggttaaaggccccttttttgctgtcttcttttgctctcttttctctctttgaccttcaggtgcctgcttcagtctctttcaagcaatttttcctttctttcctgttctaaagcctttttaataaactttcactcctgctctgaaacttggcttggtctctttttctgctttatgcccctcagtcgaattctttctttggaggaggcaaggactgaagttgctgtggacgcatatggattcactgacagtaatttggggtaactcagatctctttcactggtaaatgcccagagaggctaagccatttgtcaaagctcacacagcacagtggcagagcagggatatatcccaaaagagttccatttgcagagcctgagcccctaatcattatgctgtacaccatctctcatactcaatactgtattttctccaatagatttgaatgattgtccacaacaggcagacaagttttatttcttatagtctgcaatcttatgtgatctggcccctgcagacctccttggcctcatctcaaatcactctattcttcactccggcatattgacctttttcttgaacacgccaggcttgtccctgccttttcttaaagcctttgcatttgctgttccttcttcctggaatacccttcccccagatctttgctggatgcatctttttgttattcaagtctcagcttaaatgggatattccctagagaggtcttttccaaccacttatccaagcaactaactaccatcctagctactctttatcttatctcgtttcctttttttccatgactgttattaatatctggaattcttttaaaatttactgtttacttgttcattttctatctccctccctctggaatgtaaaccccatgaaagaagaactttcttgttcatgactagtctcagtacatagagtggttgatgtcagagaataaacatttgttgagtaaatgaataaagttctcactctttcatgacattaagtgaactttccagaagtacccagtctccaagcctccccctgtcttccagacagtacaaggaaatctggagatatataatccacatagaggcagaaagatgctagtgaagccaaatttatttccaacaagaaatagtctttgagtcttagtcattgtggttgaaggcaagtgaggtcatccattccattaaagaagaaagatcagatggaaatagtcattcaagatgcatagagaacagatagagtagagcttccataacttttgcttcacaatgattatttactgtattggatgaggttggataaacctgagcttgtctagagaagatgctacttgagttatctgtgtttggattagttttgggcagccaaaccatctggagaggtttagggctcagtcccaaggctctgatctttactcggctgtaaacgcctcattgccctgccacttctgcttcatgggctggaggtctgtcctcttgcaatcatgtgggaagaattggactctgagttggtttctattttcttatgaaaccatccaggggaatgaactgggggataaataaccaaatttctgaaatgcagctttgactacaatccagtgtctgggctgactctgaaacagctcagattgtgtgtcctgagactgtgctggctgatgacctggccacaagcattccatctcacatcccaggcatctgagcaacgctgctttccatgtggggaggtagaggatttggtgggttaattgaaactaaaatgtctgcaactctagatcctgcctctgttttggagtgacttgtaaggaaagtcaccagtgatttatacattcagggtatctttcctcaaagaactcaagatttgtggcagaatttgataaatgttgagatttgatcttgatggaagactagagattgaaaattggaagatgatctgctttatacagagaacaaatgcatccactttttttctttattttagtttattaagttctgggatatgtatgcaggatgtgcaggtttgttacatagataaacatgtgccatggtggtttactgcacttatcaacccatcacctaggtattaagcccagcatgcattagctatttttcccgaattgtgttcactttttaagatggccaggatcaggcatggggaagggaaggtgagagttttggtccccagtctttgtcagtgtggaaagctcccctctggtagaagaggcttaggaatcacggactgttcccccagcctagagaaactcactcaagatttcttaagtccaaaaaaggaaattttggatcagggtgaaatttctcattctgtaaggaatgctactgacattagcaggcaaccatctctccatacctacactcatttttaaatctttaatgaaatttcatgtgcttaaaactttttattgaactgcacatacagaaaagtgcacatatcagaagtgtacaggttgactggttttcacaaactaaacacacataattggcatcagaccaagaaacagaatattgtcacatctcggaagtcttgcttacccatgcttccacttactgtccctaatactaactactatcctgacatctaacagcatggattaatttcacctatttttactttggcttctttcattcaatattttagtcgtgagattcatccatgttgctgtatatagcagtaatttactcattgtcattgctatagagtattccattgtgtgaatataccacaatttatttatccgtgctactattgatggacagttgggttatttccagtctgagactattacaatcacagttctgtaaatatccaagtacgcgtttcttggtgcacacacatgtatggaatatatgaggagtagtattgtttggtcatgcgataaatgcgcgtttaattttataggaaactgccaaactgttttccaaggcagttgtaccattttatattcccgccagcagtggatgtgagttccacttgctccatatcaccactaacacttggtattgtctatgtgtgttcattttagcaattactgtggatacgtagtggaaactagactcacttttttattctacctgtcttttactcttactttatctgtctctatttttctgtaaactgtccttctctgctttccactccacctggaggaaaccatggtttcacccccacttcctaatagtttacatcattggtccagcttagatcagctcagccagaaatagacatttcttagtgtcaattccaaaatgagtgaaagggaatctgatccatttgggttatgttacagattgaattgtggacccccaaacccccgcaaccatatactgaaggcttaacctccaatgtgacctttttaaaggtgggtccttttgggtagatggggtttgtattcttataagaagaggaggagacacctgagagctctttctccacacacacatagagtaaagcaatgtgaggacatggcaagaaggtggaagtcaacaagctaggaaaggaggtcttaccagaaaccaattatgatggcatcttgatctgggacttctaatatccagcactgtgagaaaataaatttctgttgtttaagctgcccagccttagtattttgttgtgacaaccagagtagattaatacaggtcaggtggttgcacatgagccagtctgttgcagtgggggtgggtcaaggtctacaaatatgactcctgggagagtatacctgggaccaggtaggtggctggttccttaagcaggggccaggaaaatatcccaatggtcatcttttatagaaatctttaaaagagactaccccactaaatggcccacgagctaattcacggacctcggtaatcaaagggacattttactcagtcgtttaaccagtatttgttagacttcactgtgtgttaggcaccgtactcagtgctcaagatactgcaagattgagtctgaaaagcgtttgcactcaaggaacaaagggtggctggtgagcagatgtctgatgtttcagagtcattatgtcaagataaatgtgttctgccatctggttacactaccattaattgtatttattattaggcttccatatgatgataaataatgtacttcaactgaaatcttaaccattgcttaatttctgctgaattaacaaatctcttcctttctactactaataataatggttaagatttctgtaaggtgttactacatggcaagcattgttctgattgctttatatatactgactcatttaattttcataaaagcttaatatagtaagtacttttattattatccccattttatagctatgaacttcaaatgtacccttattgttactgccaatcacactatattttctaatccacttactttcctacacaatgacttcacatcctttcctgtcccctcaaacctccaattccacccccctatgtcctaacctttaggtgatgaccttgtttccaacttcatagtccaagaagaacttccatgaactcccaccactacatctatctacccacctgccagcatctgccttcctgcctaatagtgagatggattatctgtgctcctgtgggaagaagtctctccattcatataggaattcccaatcattttcttctactcaagaaccttatcccaaccatttgtcactttctcctctatatcattaacttttcactagcttatggattatttccatttataaaaatatgcatattaatctgttctcatgctgctatgaagaaatacctgagactgggtaatttataaagaaaagaggtttagttgactcacagttccgcatggctggggaggcctcaagaaacttacaatcatggcagaaggcacctcttcacagggcagcaggagagagaatgagtgctgagtaaagggggaagcctcttataaagccatcaaatctcatgagaactcactatcatgagaacagcatgggggattcaattataataaatgccatcatataatatatataattataatatatgccatcgtaattgatttttggtaagacctcctttcctggcttgttgactgccaccttcttgccatgtccttgcattgctttcctctgtgtgtgtgtgtggagaaagagctctcaggtgtctcctcctcttcttataagaataccaaccccatctacccccatgattccattatctctacctggtgccacctttgacacatggggattattacaattcaaggtgagatttgggtggggacacaaccaaatcatatcatatgctgttgttcttccacattaaaaaaaaatccttcaactatattttcttcgtttccctttgcagcagaatttgaaagatttttctaaactcacagtatcaaactcctctgctcccattctctctcatgaccactccagtcaggatgttgcccctaccactgaactaaaagtgtgcttgttgaggaaaacaacaacctccatgttgctaaatacaatcctttgttctccatcctctatgagacttgacccattggcagcattggcacagctgataattccttcccaccctcttgatatcatttctatatgtggattccaggcctttcactcttctggtttcttcctatctctctgcttgctctttttcatcctgccttgctggttctgcctcttctctctcacctttgaacatggagtgccttagggatccatctttggtcctttcttctctctacattcatgctcttggtgatctcatgcaatctcataggctctgaaaaccacctatacatcaacatctcactagtttatgtatccaaaccaaaccgccaaccatctctctcccaaactttagaggtatgtataacacatgtcttatcaacttctccacttggatatctaatagacatcttagacataacatgtatgagactgatttctgaggccatggcagtaatatatggtcacaaccatcttgtgactatgaggagagctggcatgaagtcaatgtcaacatgttgaaaatggcagagtagaagatgaaagagtcagtgttcttgaagacacatttgagccactctaataaccaacctaatggctgttctaattctgggcttcttggtttttgagatcacaaattctttttcatttgggttttctgttactcgtggttacagtcagcctagttatatagcacaaactggaggacaatctaatggagaaatcaatatttttccctgattgtcttctttagtctgtttgcccatgaagagactagagacaatgaaaataatgggaacattttaaaaaattatctgtaggaaaaattatctgtttccctttccccatcaagaggctagagataatgaaaataatggtggggacatttaaaaaattatctgtaggaagcaccctgagatttcctagggagattttttttttcttgaggaaagatatcttttcctttatttcctttactaacacaatgctgccacttaatgggatgagttcgtgtcaagggtgtggctagcatagtgggtgtgtaatgcgactggtgtaattctggagtgggaatttcatatatgaataaatatttattccaaactcaattttcaaatactcccattctgtagagtgagtgagtacacaaggagttctaagtatcaaagttagggttaagttctgaggatggagggcagtggtatgattcaggaaaatggtataaccactagctttgggactagacattgctgagggactataatatgaaaaatagttcaagacagcaatacctggacactgttacaactttcctggaaggcagtttggcaatgtgtattaaagtcattaacaataatcacatcttttaactcaataatttcactttattggaatctagaacaaggaaataatcctaatgaggttccctacatcatacctaccccggtctctttgcttccacttctctgtgatgctaagttgagctgttctaggctaatttgacagcacatgttaccacagtagactgaagacgaacagtaagagggcctcaggaaggtgataggaagaaaatccatttcttatttgaatccacattttgttttcttgggaaaacatgattgtttgctgtgatgaagtgtgctttccatcaggtagctcagaggaacctggctggaactcttatcactggaaaggctgaactagactgtgaacattctcttctgcaggattacaagaccagaaccctcccaacctcactttgggatctttgattcctgggccatagcaacttctattaatatctgacaaatctgaggcagcagggtctggaagacacaagaagagactgagggctgggtacgtgtaacagacaggatgcctttcttttccaagccacctccccagtcatgctgcttgatggctccaggggctttccattgtcttctgtgcagcttcctcacatcttaaatggaatatttatgtggccagatagtttcctacctcaccctctctgtttttcctcaacttcctggaaaagtgtgggaagttcttgccacttactttaggtccatatacaacattgcagtttatcacaagcttcaaggagatttggagctttcgagtctctccttccatgtcactttctattccctgcctgggattccctccagtaggatgacataacattagagattggcattgactggggtgagtgttgaattaaagacacacaggtagacacatctgggagaccaagaaaccttagctcaggagacacaaagaatgaaaaagaactcttgttgactcaagaaggaggaactcttaacacattaggaagggcatctttccccaccagttcccaaagaagaaggtatgtggaagacactggacgtctgtgcactggacagagcctccaaagcagcccactcaccctccgtacagcattctccagagtcatctatgtggtaaagcagccagcatttaggccatcacaaagctgtgctggtcaggactgcacacccccacaaaggtcgcaggcttctgctggaaagtgacaggcttccttccttccctgccctggccagcttcccatctgccacagaacccacaacctgggatatacacaacatccccaggatttccccctaggatgttctaccccacagatttaacacatatatatcctctgaaggactgccagtgagtgctgaaaaatagggtttgaagaaatgcattgtggagctgcaataaattgcctccacaattggagactgattcaggaaaagagaagacactcagaaaagaactagtgtaaattaatataagtggaggacagtgtcctcttcagaagccgtcagaaggatgtagggtgtagccttaccaatttagcaacttttagttggaaagaataaagtgtgtgaaagtgcctgagtagtgtctggcacatcataggtgctcaataaatgctagcactttggatctcttattctagtccaaaatgcatctgaggtgtaaattattttgggcttgtctgataggatcttcttttgttataatgaacataaatgtatttccctgcagcttcctcttattatatctatttctggagctttgacagaataaaccttatctcctttcaccatgacacactttaaaatatttgaaggcagaagttttgtttcccaaatgttctcttcaagacaaaattcctcaaggccttcaaccattctgcttatgacctgcttttgagggcttcatcagcttattgactcctgaatacacttgtgtttgtcactgttctcctgaaaggtgaccatgaattggccactatcctggaggaaagggagagttaaacagcatagacaaagcaggcctaccacattttctcatcgtcattcatgcaagctggtatcaaattaacttccttgtctagtttttcagaaacaatgttactatgataatttgcgctatcttactatctatgaaaatctctgcagatttttaaactatttttttgctatccataagtggagattgcatattgttcaccaaaagctgctctcccttcttccatagtagttggatacatggctggccagctagaaattacatttcccagccttccttgcagccagatgtggtcatatgactacactcttgctggttgaacataagtgaaaatgacacatgaaatttcaagtttagtcctttaaatatagcctgtgtactcctccacgtgcttttcctttttcaaagggtataacctgaacaggcctctaaccaggctccaaacacacagatgaagacaatatactaggggttggtagaaccacaagataaaggagattaaagctctgactggtcactggagtggagcattggccaaccaggatgttccacactgagatttgtattaatcagctaatgctataataagtttgtgtaacaaaaacttcaaatctcaatgacatacaaaacccacaatttatcctcatgctgatgggtctgccggtcagctgcagtttggctaatcaggctgggttctgctggtgtctctccaggttctgctccagtcttttctctctgggccaatagctgcagagggcagagtcttcttttggcagatcattggagtcaaagaggatgagcaaatgtatgatatctgctagtgaacagcttatagattttattttctgcagtcctctagcaccttattacttgccattggtccttaaaaattattaaatgtggtttagcagtctcatttttcagtcttctcaggagtctgggacatacttcagaagacattactcattttagaggatccatggatctgttgtaatttcttcaccaatttagatcttagtctctcagtatcccaattacagagtcataagaaagaatcttgttgggccagcccagtgaatagattaatttctacctaggccaggtatttactctggtccaatcatctgtggccaagaaaatacggtcctgagggctgggcgtggtggctcacgcctgtaatcccagcactttgggaggctgaggtgggcagatcacgaggtcaggagatcaagaccatcctggctaacatggtgaaaccccgtctctactaaaaatacaaaaaaattagccgggcatggtggtgggtgcctgtagtcccagctacttgggaggctgaggcaggagaatggcgtgaacccaggaggcggagcttgcagtgagctgagatcgcaccactgcactccagcctgggcgaaagagcaagactccatctcaaaaaaaaaaaaaaaaaaaaaaaaaaaaagaaaatagggtcctgaaataaaaacatgatatattagtctgttctcacactgctaataaagacataataatgagactgggtaatttataaagaaaaagaggtttactggactctaagttccacatggctgaggaggccccacaaccatggcagaaggcaaaggaggagcaaagtcacatcttacatggtggcaggaaagagagagagcatgtgcaggggaactcccctttataaaaccatcagatcttgtgagacttattcactgtcatgagaacagcttgagaaaggcctgcactcatgatttaactacttcccaccaggtctctcccatgacatgcaggaattatgggagctacaattcaagatttgtgtggggacacagccaaaccatatcacatgacaacctaaactcatttattcagcaaggtctgtggatgagtggcaatttcaaagaataggatggggctagctatgtaccccaatcacatggagtttctggaactgcaaatcaaggaccagatattgggttacacatccctacctaagcactgacaactgggaagacagcttgcaagctaccatgctctcttgtggtagattactacattggtggcctccagtgaaccacatctcttggtatttacaccctgtatactcatttcccacactgactctgtacttgaccatggaacttgctttgcctaatgagacattagccaatgatgtcaatggaggcttgatataggattgtacactggggattgctctcttgagatgcttcttctcagaagccaactgctatgctctaaaaaagcttagactaaactcctgaatggtgagaggtcctggaggatgagaggctctctcaatgtcttagacccagccaagctccggctgaatgcagctcatgagtgacctcagctatgccatgtggaacagaagaatgagtcagttgataaaagtgagttcacagactcatgaggaaaaataaattgctgctgttttaagccactatattttggggtagtttaaaaggccataatagataattgaaatacttcccctctctaaaatgtccttggtgccaaaacccatctggaaatgcagatgtctggcccagaatccttggagaaaattttttggcactgagaatagatccaaaggaccccagaaatggaatctggagaggtcgtctttctctcctgttctggaaattaaaattattttcacaaatgctgaaaacaaaagggaatccttaaaccatgaggcataagaatgttctattacctaggccagataaggccagactctcacacagtgccccgcactcttctcttccataccctgtctccttctgaataaaatacatcgacatcaacggaaagccatagattcttctggtcctccttagacaccaagagagaagactcccattaagtacctcctgttgcattgcccaatatcctgtgaggtggtccaatgtgtgatgggttgtatgtccttaaagactgaagggaaaatgtttctgattaatgccagagattactcagagaagtagagattactcagagaagtaaatattaccatcttctgaggttatgaaaatagtagttggtatgacatctcagaattattttgggtttgtccctggctgaaagcaatatgaccccttaggagcctcagttccttactgattccacaacactaattcagaatgtgttgttccaagaattgtctacatgtaccaagagatttatattctaaagcaccaagatcatcagcatttacaatctcttctctttcagcatatgtcactgagaaaaccctaaattttgccaagcaagttttcattcatgcattcaacaaatattttactgaatggctaccctgactgggtatccagcacggtagtgtctatacggtggcctagtggataccttttttgggtctatctagcattcattcccacgaaccaccccccaccccccactccccgccgaccagccgaccagtgaactaagcaactcttttttttttttttttttgagagtgagtattacttctttcctttcggatccattctaatgaggcttctctacctcctcaaaccaagaatgctcactgtgatccaagctgggccagttgaatgttctcactgtggattttaaatcaaaacagattgataaagactgtgaaaacaagttgctatttgggaattcccatgcccagtgagacagttttttactagaacattttctgttgttttagcttcctagattttagagtttccttgttcctgtttgtttccaagcactcttctctggcctgactataaactccagatgtccttccaaagaagtcatttttcattagattacccagacagattgctgttgctggcatccaaaacacccgaaataatataagagatgaatgaaacagacatgatcccagctttcagagcctgtcaatttggttgggtagacagacactaaacaaagaaaaaatatgtaattacaaattgttgtaaaataaatgaacagagtactatgaaagagaataatagggtaatctaattgagattatggggccactggacacctcaactgagatctgaaggatgagcagacaaagagtggagggaaagagcctttctggcagagggcagagaacaaacgaaggccttgagatagggaggagattgttgcattccgggaactggtggaggctggagtccttgggaggagtggcgtgagctgaggcaggaggggtgggcttgggcctgatcatgcagtttggttgtttatgaagataatttaaatttgatttcaaaataataggaataaaccatcagaaagttataagtctggcaatggcataacctaattagattttaaaacagcccctcttgctaccatataaagaattggcttgtggggcagacatagaaagtaattgagtggtcggggaaggagatgatgcggcttaggctagggtggtagcaaaggagaggagaacgcaaagccctatttggatttagaggcacgagtgggcaaaacccactgctttggagcatgcctgccttgtgggcaaggacgtggtcctgctcgtttctacatcccatgaaatacctaaataacttgtgcttttatagaatcacacaatttacaaagtgcttctgtgtccagatctcacttgatccttgcagcagtcctgagggttgctgaaaacaaagcagtcaaggctggaggaagaagtgaaatggccattgcatacagttggtaacaatcatgccaggacttacatcctactcctctcattatagcttgctgcccggctcagtatccacccccagaaatgtttgcagatctgaagatgaactgaggtcctctccactgctctttggtgtccatttcttgtcccactgaacctgggctctctaagatagtcctggaagctcatttgcatccagttccatctcttaccctgtggcgtatttaaccaatagcaggctttggccggcacatgctgaaggcaatatgacccctggggctcctaaaaggtcatattgccttcagccagggacaaaccccaactatttctgagatgtcatacccagtgctatttggccaaatcatacattcctatcaccttttatctctctctgcctggatctccttgaacattcttttaatcatttctgttgccttccctggaatgcctactcccttctgggtaagtgttgtctggactggcagcatcagtatcacttggcaacttgtttgaaatataaagtctcaggccccaccccagacctactgaacgaaaatctgggggtggccctgccatctgtgctttaataagcctgccaggtgatttcgatgcagacaaaactttgggaaacaccagcctaagtctttccaggaacaagctctcaagctgcagacagctgggctcagataaagatgtgttttatatgaacccgtgtcaggggctgaagtctctgatggttcttacccaagctctgggtccacatggctgaaagacagtgacagctcgtgaagctgtacagggtctttgcaggaccgtcctctgctgatctttaacccactgcttgtgtggactgaatcagatctttaaggaggaaacctggaagaaggtactaaaggggaattgcccagcccttcctgactttgccctttgcattcatgtctctattgcccatcaaatatgagaactgtctagagccagattggctcaggttaaccgaacccttcttggagacagggatcagtcagataggtaaatgcttacaggtagccctgataagtaccatagtgggggctgcgtattagtttgctttactgccataacaaaataccacaggctgagtggcttaaacaacagaaatttattttctcacagttctggaggccagaaatccaaaatcaagatgtagaaagggttagtttctcctgaagcccttctccttggcttgtgaatggccactttctgtctgtgtcttcttcatgtggtcttttcactgtgcatacatacccctggtgtctctttttgtgacacctctcctaatctcctctgcttgtaaggacaccagtcatattgaattagggcccccacatatgacctcatttaactttaatcacctctttaaaggtctgcaagtatagtcacattttatacaaatttatttatttggagacagggtctcgctctgtcacccaggctagaatgcagtgctgtgatcacggctcattgcagctttgacctcccaggctcgacggatcctcctgcctcagcctctcgatttgctgggaccacaggtgtgcaccaccacacctggctaattttttaaaattttagtaaagatgatgtctcagtatgttgcccaggctaatctcaaacttctgggctcaagagatcttcctaccttggcctcccaaagggctgggattacaggcgtgagccaccgtgcccagcctctatgcaagtttataatctatgtgagctatgtatgtgtgtgtatgtatatatatatatatatatgtgtgtgtgtgcgtgtgtatttgtatgcatatatacacatatgtacatacaaagatcatatagattgtgatcttacatcctaaaacaactcattctgacagattttatatatatataaaaaatatatataaaatatatatataatatatataaaatatatatataatatatataaaatatatatataatatatataaaatatatatataatatatataaaatatatatataatatatataaaatatatatataatatatataatatatatataaaatatatatataatatatatataaaatatatatataatatatataatatatatataaaatatatataaaatatatataatatacatataaaatatatataatatatataaaaatatatataatatatataaaatatatataaaatatatataatatatataaaatatatataatatatatatatatataaaatatatataatatatataaaatatataatatatataatatatataaaatatataatatatataatatatataaaatatataatatatataatatatatataaaatatatataatatatataatatatatataaaatatatataatatatgtaaaataaatatataaaaaaaaatataatatatatatatatacatatatatatatattttttgagatggagtctccctccgttgcccaggctggagtacagtggcacgatctcggctcactgcaacctctgcctctcaggttctgattgtcctgcctcagtctctggagtagctgggattacaggtacacaccaccatgcctggctaatttttgtattttcagtggaggcgggggttttaccatgttggccaggctagtctcgaactcctgacctcaggtgatccacccaccttggcctcccaaagtgctgggattacaggcgtgagccactgcacctggccagattatatattttttattttacaaaagagacacgagtttcagaagtgataagtgactctcctgaggccaccccactaactggtgccagagctgggattcagactccatccagctggcccagagctgagcttctcgccctgcactgccccacccccgccatccccacctctgatcacctcccgtcagcactgacacaagaaggcagagcgcggctcgcctgacctcagctgggaatgtgggcattcagtgactctaaggtcttggttccctgcatatgtccacgaatgaccacaaaagtgctacaaatactgatttgggggttacaaataaatgttagggagtaggtgaatttgcaaatacagaacctgtgaataattaagatcagctgtacatttttcctattctccatgagaactagcctccccttcttcccatccttgcccttttctcccacaatttttgttatcagggctctgaatttttccagagtcgctgattaaaaagcctctccacgggtggatcacgaggtcaggagatggagaccatcctggctaacatggtgaaaccccgtctctactaaaaatacaaaaacattagccgggctcggtggcgggtgcctgtagtcccagctgctcgggacgctgaggcagcagaatggcgtgaacctgggaggcggagcttgcagtgagccgagattgcgccactgcactccagcctgggcgacagagccagactccgtcaaaaaaaaaaaaaaaaaaaaaaaaagcctctccaaaaacgtcatcaaaatatacatctatgcaggctaatgacagccctaaagagccagatggacatgcgtgtgtggacatatggagacacatttgatcttcgtgggcccagccagcaccattcctcatggctttgtgaggacctggaagacaaggcagatcatgggaatgtctctggccaacactttatagggtttcagaataaataggaaaaagggagtactaatttatggcaagggaattaggctgcatggaagatgaatcaacgtgatctgctcaaaatggacaggatattctgctagggcaggataatttttgtggaatttggggaaataaaaaagtgtgcaagtacctttatcttgaaaaattgtatcgtaattcttataccattatctcgtatcctgctccttcaatcccaatctcttttcacaatagaatattattttttccgattttatggggattaaaatgtctttttgccatgtcttttttgacctagactcagaccatcatttctccaatattattggttatacatattgggcctattcagtgtgggaggggaccacaccgagcgtgaaaaccaagatgagagaatcacggggggtcatcttggaggcttgactgccatgttgagttactcccttgctcaagaactgtcactggttccttattgcctggctctaaggtacaaattcagaactcaactgatcctctttcattaactccactttctaagccccatttctctgtcttataaggtttgcaggctgctgatccccacacacaatatgtccctccccacctttgactatgccactgcccccagcttaaagcattcttcctgctcatttcaccatgtcaagatcatctttctctggatagcattctggacaggaataggaacatctggaagtcttccaagggataataatctaatgaaagaggaagccaggctcccaggtgtcttccagtgatgattttcagaggtctaagaaaagggataatccagagagccactgtaggggacagaggaaggagacttctgtcactcagatttgtcctcagctaagtcctttaggggtttatattggagtcctggaggagaatgagaagctgggagcaaggaagcattccaaaagctgctctcccacttattctgtgagccataaagctaaaagccatatgaggttggccctcatgtgacaaagtatgatgaaaacagagagagagagagagaatgatagagattctcagggtatcagaggcaccagcaaggagatcctagcccagtgcagacccctggaaacaccctcacagacatcatggacattaccaacatgagttgcagcaggattggggaacatggtggctgccacagatggccaagagaacttttctaacagcacatctgagccactcactgtgtgctcccagaagtgattgccttgcaggaggctgggggtcctgcaacagcaagcctgggtgagagctaaataaatgtggggctttgttacgtatgcgactccactgtactccccagagcagcccatgtcatttctcctgtggggctgagagtgagtgcaattcatccccttggtggagcttccaaaggcttcagaaaaacaggtgaattgtgagtggcccatttaatttcagtaaacagagaaactcatcccctgcaacctccccaaacaaaacccctcagagtggatccctgtgttgatgactaggaggaagaaatgtttgcatggtaaaaggaattctttctcaagggcggggataaaaaggggaggaaaaactaactatacctttacctctataagcaacggtggaaaatagaaggtgtggcatttctttgtatcactgaagacaaaatcaacatcttaatttatcatcactctcatagccgttgacaaggctatgataacattgagtccttggcctctaagagattttaatctggtaggggaattcttaaaacagcattagctgagtgagagccaaagtggggtcaggagagaggatggggaaggaagtgctgagaggcctcagacaacaaagatgtcagagttcccaagaggggccatctctgagggccggattcaggggaccttgggggaagggttacaggagctacatctcaggggctaggtttggcaagtggggtttaatgcaagggagaggaaaccagggaaaggcattctggacctcataggtaaagttataaaagtttccctagaatctctgctggtgtctgggacatgttcagccaaggcctttcttttgctgtgatggtgcaaataccaggtccagcccagagtgaaaacagctgtgtgtctctcatgtgccccctacctcgtgtgtttccattaactcatctgcacattgttcaatgacaattatgctttctggctactcacctatttaaaccctcagactgtaatggcaaatacaataaatctccacagtggcaactaaatattgtctgcagaaattgtggcagtttgagtcatgatgctgaggatgtgaggtttgcttgggtagatctcctagtgcaggccaggaatgggtcagaaaccttccctagaaagaacatgttcttcagatgttacagggcaagtgtggtgaccaggagaaactccagacatgttgagtggcaaatgggacaggtagacagcactaggtggagtcttgggaggacagcaaggaccaggcatgaggaaacggtgtcatctttaccagttcctgattttccagtggcatttgcaggcttagaggtggagtcactgctcttggttaaccagccccagggtcctgtattatgcctgtattttccctacacattaaaaaaaaagtacctgtattaattctcctcatagtaaggggaaaaatagccaggtttttgaaagacttaggaggagcggtagaaaactgccttccagtggcagtcaaagaaagaatggttgatcttcagtctggactcgttgctctgaggacaaagatggctttagttttctcttcataagatcaagggctagcagccaaaccaaccagccaacccaccaaatactctatttagtatccaaactctggctgcaaattcataattaaccaagccaagggaaaggcagaggggaatgaatgtttgtccaggctcagcaggcaataggaaagtaatgctgtgtgctctgggagagctgcaggccttgctactgaggacacgtgactctaaggtctgctttattaccccaacctttcagttgttaaacatcttgtgaattataaaagaatgatccttatcacatcccacaagccttcctggtttggctatggttccttattcctgcctggggtctttaccattgtccctctacttggaatgcttttcccctgttcttcacttacatagcatctacttagcctttgggtctcaggcaaatgttactccctcagtgagtcctattggactgatcaactgggactgtgtttgattgcaagtgagagaaaactcaacttctgaagcttaaaaaagtggggtttattttcctaacttaagaggtaggcagaggtacagagtgcaagctgagccacagcttgacgatgttgtcaagaaccaggcttttcctgtctttccatccctctgtccttacagtacttggcatgctgcctcgtggttgcaagacagctgccatgcctccaggcatcacctctacacttcagtctggaagaagaggaaaggacaaagaagaaaggataaagaacaagggctgttacaactaggtctatttttttttatcagaaaaccaaaatattttaggaaggtctaattaacagactttggctttcattttattggccagaaatagattacatggcctctccacaaccaatcactggtcaagggaaataagaattcaaagactgcttagaacaacttcaagtcatcccttgagctgggtaaaggcctgtactctccaagacaaaaggatccctaggtacttgaaataatcagggttgtgttagcaacaaatgttgtctgttatgtcctccctagctatccaatgaaatgagccccttatactctcaatgcccttgctgcaatttgccattatatgttcatttatgtgtttacttgtataacacctaaatgccgcactagacttaaagctgcaggagggaagatactataaatgctttgttccctattcaacacctagcatagcactgagcatatggtaagctctacaggcatctttattgaaccaatgaaagaaacaggctaggtgtggtggctcacacctgtaatcccagcactttgggaggccaaggtaggaggatcgcttgaggccaggagttagagacctcagcttgggcaacatagtgagatcccatctctacaaaaaatacaaaaactggttgggcatgttggtatgcacctgtagtcctagctactcaagatactgaggcagaaggatggcttgaacccaggagttgaggctgcagtgagccgtgattacaccactgcactccagcctgggcaacagagtgagaccctgtctcaaaaaaaaaaaaaaaaaatccttgctaaagaggtcatgcaatatgcacagaaatagctgaaatagctcctgtaacagggacctgcttctctacttttgcagcacttgatgtttctggttagagaattcttcctaatgttgatctgactctctgtgatttccacccttatcatgggctgaattgtgtccccacaaaattcatgttttgaattcctaactcccagcgctttagcttcagaagatgactgtatttggagatgggggtctttaaaggggtaattaaggttaaatgaggtcactggggtgggccccactccaatttgactgatgtcaaagaagagatgaaggcagagacaggcctagagggaagaacacatgaagacacatgcggaagacagccatggcaaaccagggagagaagcctcagaagaaaccagctctgccgagaccttcatctaagatgtctagcttccagaaaagcaagaaaataaatgtctgttgttgaagtcacccagtctggaatactttgttgtggcagcccttgaagacaagtacagcccctctccgttgcagaccatcacaatcttcaagacacccatcatatcagctctgcaaagtctgtttttgtaaatacattttgtagcagggcaccaagtcagctcccctctaactccaaaacttgtgtcctttttctttatcaaagcagccaagtggaagataggcaggggatataatttgcttgtgtgctagtttctttccctgaggcaatagtgacactttgcattcttgatctttccttggattggtgatagtagaacagttctcacttgggttttcttccagagcattcgtgggttaacatcctttctccaattcttataagcaaataatagccaaatgtgattcattcttgcccgaaaatgttgatccttagaatggatttatgtaagtgtctctgaatacaacaaattttcctttgttagtgatttgtggtagctaatgtcgtaatagtgatctcacttcagcaagatattggctctcccctcatgagtggtatgttagtcagcaaccactacaatatgctgcatgacaaactacttaaatcttgttttaatgcctgtgggttgaccaaggcagctctgcttcaagctgaggctcaagttcatattttctctgcatctctcattcttgacccaagatttggggcagtggtgacctggagcataattgtctaatgatggaggttagagtctcttggagggggaggcagaaatatgatggccctgaaaatgtaggcctggagtgagcatattttcacttccactcacatttcattggctaagcagtcacaagaacaagcccaacatgaatgtgtctggggatatccctcctccagggaggggataaaaggagtgaatatttgtttaacagtaatctagtctaccgcaggtggtcaggagagtcctggggtagaggccatcagcctgggaaagccctggaagctaggcttccatcaagtagtggggagaccccagggaaactgggagtggatagatctaaagaatgaggcaattcttgaccttgggagggtacagagttagagcccgagtattcagaactgtggtgaactccaaaaggccaatggtgtatccaagagcaggactgtggtctggggagtctgcagcattttggaaggtacctgctggtgtgagggtgtatatacctgttggaagatcccaggtcaggaggttagaaaaaatactctcgaggtgcttccctacttctctctccatgtagtcctcttcatatttaccctcctctctggggcccactttttctccctcttgctcaaccctgctttcagaccatatcccttcttcactcttccatgccccttcccacaaaaatgtccacaaggccttccatactgacacccgtgcatcctttggagaaacggatcaacttgcaatttgcatgaatgaaactacatgggtggctcatttgtaactctatcctgacttggaagctgaggatgcagagaccctcagagtaactagcttgctgaggctctctgaggtcctcatatcagttagagcaaggctgggaccaccactgtgctttgggggtttatcatttctactactgatgacctactgttttaaagttcactgacttgtattatttctaatttaatttcaacaactatatattatttctcatgagtatgcgggtcagcttggggtcagggactctaggttgggctcagctgtgtggctctgctagtctctgctgggctcactcatgcacaaccagctggggctagacagatctaagatggatctggaaagtggccctgctccacacatctctctttcccttcctgtactgatgggctagcccaagtgtgcctttctcaaggcaatcacagaagtgcaagagaacaaacagaagtgctttcaaggcctcttgaagcctagactcagaattgtcatactatctgtcattcagaggttccccaagaccacctgtaagttcactgattcactggaaggactcacagaatgcagcaaagctgttatactcatggttacagtttactataggaaaatgatacatattaaatcagccatggagaaaaggtgcataggagacagcaggtgcaaacttccagctgtcctctcccagtggagttgcacagacagggcttaattctcccagccaggatgtatggcaacatacatggaacatggccacccagggaagctcactccaaccttagtgtccagggttcttattggggtctggtcacataggcatggctgactgcccatgtggtgggccttagtttccaacttctccagaggtcacctgaatactatgtggctcacagcccccgccataaatctcatttagtgtagactatgtgacatgacccacgggctccaggtaaacaatgacattcttatcaggctgccacaggccaaaacttgctttggaatgggcaggtttggaccacccaggtgtgctgagttaatccttcattgcacagcatccttctgcctccttctattggctaaagcaccgctgacacagctgaatccaggcagattgggaggtcactacagtcgcataacaaagggcatggattcagagagaggtgatgatctggggccattaatgcaattcaccatgaaggccccacctgggctgaggcgtgggctggcacatgggcagccacgggtggtcatcctcgtcttatcgctgctgggacataatgcatactcacatctctgtcctgtgctgttctccaccttctcacaacctctcctctatccagaaagttccaactcaaatttcaagactttcctcctccatgaagccctccctggccaccccagcagacaggggcctccgcgtgaacagacgatgatgaaactagtgatcacagttttaccttgtctaatgctttgagatggggagacagctcctttgtcacgctttctgattctttgtctgtccccttctcctgatcatcctcaaactcaatttcacccaggataatgacttactcagttccaggtttgcttcggagactcccaggcccagccgtctggttgtattcctgactgaggcctgttctctgccaggagtggaaaatgcagatccattcttctgactgcggtttccagtcctcagctggcacattccccgcttgattcttctcctccctcatgcggaggctatttccactgcagcgctaaagtagttcggaccccttacaatccaagctccatttcccaggcctgcaaaatgctttgtgagcaaagatattgccttctccttgatgcccagggtgtgcaggtgggggaacaattcacatggcctgaatcacagcaactcctgggcctgtctcaaagcaaaaccaagacacctgattgttttatctgaccttgaagatgtccactgcctcttcctaaatgccacctcctccatgaaacctaccttaatcccttagtgggaaggatttctcctcattctgaaaaattacatctcacaacacattcttcataagtgccccatctcccacaccatgttgtaggtaatctaaggccaggggccatatctgttccctccatgacacccaaggcttagggcactgttcagtgatagctggtaaatggtctcagacagcctcagtctctaaaagtcaaactggaaagagaaagaagaggtcagatgatctctatgtccaacccatccctgcaggtccagagccgaggaacaggtgaggccactcgatggggatactgaggctgagaaggggcctcacagtgccaggtgagtggccagtcaggcaatagggaactcgactccctcacagtggggatttgttttagtcacctttatatcttaggacttagtaaaacgccacccaccaagaaatatcaagactaaacaaagccatgagtgaggagcaggcagcaagttggaagccagaggagcaggtaaaatcaggcactaacattatagatgggaccaaagcaagtggtttctttaaatttttttttttatttttcattattatgggtgcgtaatagtgtatatatttatagggtccatgtgatgttttgaaacagacatgcaatgtgtaatgtaatcacatcagagtaattgtgggtattaataaaaagatcttgaaaggctgaagttgggggtgggatagtggtcccagagtgaatctggtaggcttcatttttttcctgctccctccagggtcggggctgtggcccttaagcagcagctcacccaccatcacccccaggctgtacctatgtcagagacttcgatagcgtttaggaaggacgctctggcttgcccccatcgatactcaggcatcaactcatccatggtggcaccatgtttacagggccaccagtggccgggggtgtcttgggaagaccagaccagtggaagccccagttaaaggtaagagaagctcccgggtgctctagagaagtgcttctcaaacctgaatgcgagcacgagccacttgtggattttgctaaaatgctgattctggtttggtaggtctggagtagggcctgagattctaccttcctcacaaggcacccgggtgttgctgacgctgctggctcgaggactttatctgagtagtgaggggccagactagcaatggatcttaatgctggctgcaaataatcacctggtggagctttaaaaaataccaatatctgttgccaatggtgggatggcctgccatcgtgtgggtggttctccaagtgtggtccctggacccactgcatcagcatcacctgcaaacttctgagaaatgcaaatctcaggtctcactccacacctcccaaatcagaaactgtggagtagggcccagcaacttgggttgtaaccagccctccaagtgcatgctgtagtttgtgaacctctgcattttttttgcatcctaatcttatgcaatgggaagtatacaacatcacacaaaatcatttatgtgaggttcttactggacatatttgactgaatctagtcatgaggaaattatgactttctcaggcttaataatgctttgtggttctgcaggagaatgtccatattcttacgggaggtgtgctgcaacatttaggggtgaaatgtctattttcttcagcgacttgaatggttaaagggaaatgtgtgtgtgcatgcatgtgtgtgtgtgtaataagggagatggagtaaaatttcactttgttgattcaaatgtgtacccagtattcagggccttgattctatggtagcttgtcttaaactgtggtcataaaaccacctgcatcagaacctctaggctgctggtttaaaatgtaaatcctgaacctcatttatacataggaatcggggtctctggggtagggcctcaggtaggcaccatagagggttcagagctaatatttgagagtcattgtttgacactctttgtcagagagtattaggtcaccaatccagactgctacagggtccaggaggtaaactgaacaagtgaagcagcagctggtgtaaggcagtcgacgctggtggggactgcagcaaatgacagaatgtatgcccagtttaaagctccaacttccagctgactgggatacaatgtcttgctagtgctgctcagtgttgctagatctttctctcttttttctcaagagacatcagaaatctggagtttttaatgtgaaacccctcaattttaaaatgttggtgacttacttaaaaagtattgaaacaccactgaagtgaaacaaaacatctctggaaatagtattcagcctactgaccactcgtttgcaatctctggcatggacttagctaagcaaccagagtactatgagggccatggttcaagggttccctagctcatcagagaagaattccacagcttgtactctgatcatgttgccatgtccctgaacaatgacttcctctgcaggaatcttcccaaagttcccctactgttcattaatggtgtgatctgtccacagtttcccttctaggctgttagttggtggagacaggactgtttagtggctgaagctgggtggcacaacataccgagtgttccttggcctgcagcccagaggcccctggtgctcgattttcctggaccacagtgcgtcttgctcactgaaacccttacagaaccaacagctggaaagttgtttgctgagcccaacctgggattgggagagcaagagaacttgtgtggacagccctttcattctaaagggtttttcttcccatgttgggcacttcctgcagctcccaatccaataaccatgtcaactgtccacagatcccaggataccgagtctctggtcccatcagttccactaatctattgtatgaacttgaaccagtcacaccctctctgcactatcagctcctctcctgtggaaggaggctattgtcagtgatttttcagcagcagagctctttttaaaaaattctactgaagttttccagcaaaaccccaaaataaaatcaatgcaataaaggctttcctcaggaagtttaattcttccaaggttgaatggtacatgtcaatgtttgccaaacccctcatgcatctataaggtcctaaggaacagagtttgaaaattatggggcttgctcaaagtctttttttaaaatttggaaatgccatatctaagatgttttcgagcaatttcctctaggtctcccattagttcacacattaactgcaactgcaaggaagtccacctctctgaggcatttattgaagcctcctgcttacacagaacagtactagatgctgtaaagggaaatagccatggcctccaatttagggttatggttgacctggggtgtcaaagaggaaaggaaccttggacatattctaatcctatatttataacctattctaacccatggcctctttctgacaaatataaaaatctcacaggctcagagcttttgatgtaatccccaccagtggtttgagaaagcttttgtccagctttgccttctgtaaattatattatgaaaacaataggtattttttttatgttccaaacaaaaattatgtaacagtgtattattggcttggcttggtggctcacggcctgtaatcccagcactctgggaggccgaggcgggttgatcaggaagtcaagaaatcaagaccatcctagccaacatggtgaaaccccatctctactaaaaatacaaataattagctggacgtggtggcgcacacctgtagtcccagctactcaggaggctgaggcaggaggatggcttgaacctgggaggtggagcttgcagtgagccgagattgcaccattgcactccagcctggggaaagagcaagactctgtctcaaaaaaaaaaaaaaaaaaaaaagagtgtattattgaccttgcattttccaaaatatatacatgccaacccaaagaacgtgatacacttccttcatcccctgctttccacctttaccccaccctcatctattgacaataactgactccgttcattctttttcatttatattgcaccttggtttcctcaactataaaatgtgaggacataatatggagagttggagcaggggattggtgaggatacaggtgaaacaaggttggccttgagtagataactgttgaaactgggtgatgggcacatagggattcattaactcttctttccatttttatgttatgaaattttctataataaaaaggttaacatgaaggtaatttctataataaaaacattaaaataaagataatgttactgatttgcaggttgatattgagtattttacccagttgcaagccaagaagcactatgaacagcatcttcatttgctgcagccacatctgaccttggttcccataccaagttgccacttcctgactgtaaccatttgcggctataccagaatctcacaatgtgccccgtgaaaaaagacaaggaaatgcagcagtccaagcccctaactggaggaggctcctgactctggggacttactccttcactcatctcctgccagcagcagatggagccggtctgggctatggaaaggccctgagcgcaaagggttaacacgctgcccctggaatgactgggctttccctcgattggtgctgcctttcaggcccaggcctgcctgatgattcttggtgtaggttaaaggaccatgaatttgtggctcctgagtgcgtggtaatgagctcaggcaccaaaaattgagaactggttatacttggcttctccatccaggttgaaatagctcacctgtattctgagtggtgaagaaagggctttgagaacactggatgcctgaggatgggcagtatagcctccaaaaaaaaaaagaatcagaagctggtactaactaaagaatctgtgagaccgggcacggtggctcacgcctgtaatcccagctacttgttagactaaagcaggagaactgcttgaacccgggaggcagaggttgcagtgagccaagatcgcaccattgcactctagcctgggcgacagagcaagactctgtcaaaaacaaaaaaaaaaatctgtgaggctcaaacatgggggtgaggggtgagaatagggcaccaaaaggactgacatctaaataatctgtcagtgacaaaatggcttccaactaattaaacatagaaaaacctcttttagggaagataatcctattggatctgcttgcaagatttttccagccagcttctgcctcttggagcttcaattaaaagctgtttagcagatggcaaattctgagttacaaagttagactctttggcaacgatatgtgcttttgctttcccaggggatcctggccacatatggccctggaagaggcgcgagagctctttcttggcacacagtagagagctcctctcccagcttaacacacagatgacaggcatttcaacataaccatcaagggtggtgagcaagaggggagttttcagttaattcagaaatatgggggccctggaaatcataatatatcagggctggaagggaactcaaacagcgtctactacaaccccttcttcatacagaacgagggcactgagccttggaagaggttatgcaatttatctaaagttgcccagcaagggagaagcagagtcgggatcaggcttgtgcttatttaccatagaagcacttctctattcacttggaggactgtgttcattgcctgaccctttccttataatcacgaggctcctgaagagatattttaccaatgacctgacaaatttgccagaaggccttgaaagggtcattcatcctcatgtccacctcctgctttattgcaggacaaaaccaggaccctctgaaatggaacttcatcactcttctcttcaaagctttctactacagttgaagtcacagtttctcttgggtgctgtcaaagagaaacagaaccggacactaaattaaagattgggggacaggttttattcagtaaaattacagtagaggagggaactcagtataacctgagctcaaagagtataactctatcaaaacaacttccattccacaattctattttgaagctcctcttttgtagtagacatggtcatgtgctggacatacaacagtggacaaggcattcagggtcccagctctcatgggtctcacaattcagaaggagaaacagacatcgagcgtatcattttaataatatttacataatcacagttggggcagttttaagaaataaaaacacagtagtgctctgatgatctattactgcataacaaaccatcctaaaacttagtcttacaacaatgacaatagattgcatagtattgagcagtcaacagagatagctcattcctgctctacttggcattagctagcatggctcagaagtagggtactgctatcatttgaaggaaaacacactcacctgtctggcagttaatgatggccggcagctgggacctcagctggagctgtcagatggaatacatacacgtggcctctccatgtggcctgggcttccccacagtatggtggctgagttcccagggtgtgtatcctgagaaggatagtggtagaaaccacattcctttatgacctagactcaaagtcacacatcgttgcttctgccccattctagtcaatattgcaaacagaaagtattgcaccatttcaaagggaggggaaatagacaccacctcttgataagggaatggcaaaattttggaatagcatgataaaagtatagctgtggtgattttttcaaaatacaatttctctcaagtgtctgtgagaaagctaagaacctatcagaaggaatcaagaaggtgtttttaagctgggacctggagggcgaataagactaagacagataaaaagggaaggagtaggggagaggagagaaatgttccagacagtggatcctggcacagaatgagcttggctacaggaagaactgaaaggaagccaatgcggctgcaacatttataataaaacgaatgagcaaaggttcataataaaaaagttgcagcaacttgaaagtgcttagtagggaccctccagctaccatcaggtaatgccatgcttaaccagcctacacctagtctcttggttacctctgcctgcataacaaaccatctcaaacttaactggcatacaagaacaacatcatttatttttattattttctctcatggttctggaggttgactggattcagccagacacctttcacttggggcctctcatgttgctgtagtcaggtggtggctgggcctggagtgacctcaaagcctttctcactcacatctttggtacctggactgggaacactcaaatagctggagctagaccagctgttgctgagcatgcatctcttattcccactctctcactctctggtctttccatgtggtccctccagcacagcagctcctgagtagtcaaacttcttagagggtggcagatgactcccagtgcaagtatcccaagaaaaaccaggagaagctgcatggccttttctaacctagacttggaaatcaggtagcgtcactgctatcccatgctattcactcaggtgatcacaaaagcctggccactgttaaggggaagggacatagatattttttttttaaatggagttttgctttttgcccatgctggagtgcaatagcacgatcttggctcactgcaacctccacctcccacgttcaagtgattctcctgcctcagcttcccgagtagctgggattacaggcactcagccaacaggcccagctaattttatattttagtagaaacagggtttcaccatgttggccaggctggtctcgaactcctgacctcaggtgatccacctgccttggcctcccaaagtgctgggattacaggcgtgagccactgtgcccagccgggacatcgactttttgatgacaggagtgtcaaagaatttgcagacatgttttaaaactacaacacttagggtaaccatataactcactgtccaaagcaagatacttttgagagtcaaagtgggcacttttgagagtcaaagtgggcacttttcaggcatgagctaggactgtccttgggaaaccaagacgtgtggtcaccccactgccatgcccgcacgagtgggagcacaagctctcttaaattcttttgtctttccgacattcatcatgccatttgtaaacatatgctttactcattgaaattggttttaaattttattttctgtttctttattttctgtttcttgcttttagatgatgaatgttatgttgaggtcgccttttcataatgaatctggaacttgagagctacaaatcttgcccaacaatatctttcatgcaagctgggacagctgctggcactgtggatataagtgcttaggatgccttctctcttagatgagagaaccccaagcaatggaagaatttgcttcaagaaatgctttttaaaaatctcactttttggctaagtggtaaaaaacacacacacagtgatgactcatcagttgaaatcaaatccttcatcccaaaaaagtgtttttataagaagtgggtgtttttttctttccccaaaggcagactgcataatatttggtgcttctcttttctgaataatttattccgtttcagtggaaattgacagtttcagactggagccaataacattttattttcagagctatgcttggtacccccattatccagggatctgcttttgcctacaaccctaaggggagttcagccatcaaaccgtttcacaccagcacaattcccctcttcctcccttccctttgaccagctactaacctgttcttctgaagaccctggagcagaataaatgcctagagagagcatttggagaccgcatccaggtatacaaaagcatggcaagtttattgtttttcaggagcccaatcacagaatcgatccatatctcctgacccaggtactccactcagaagtctgttcttttcacagctctcctctacaaaacattttctttctgttgtttctttcctaagactctacaactctgaaagaaagcaacgtgattcatttctgatccgtgaaagtaaacatcctattccattccatttgtcttcttggaagcttccacaaatgtctccttgctagaaaacaaaaatacaaaacttgtactcatttctgttccagactgaaatacatgggaaacttttatgggtcctggactatagtctggccttcatgaattaagaagatatttaagagagatataacaatagagttaagactaggaaaatagttttaaaaacttctcaggttgaaaacagcagcatccaacagctgctcagatcaagagtgggactagacttagggtgaccaactgctatggactgaactaaaatacatatcttgaagccctaacctctgatgtaatggtattatgagacagagcctttggaagatgaggaggtttagatgaggtcataagggtgaggccttcatgatgggattagtgcccttataagaagagacacaccaaataccagatctctctctctctctctctctctctccctccccccccataccccactgtctagcacgtgaggacacaagaagaaggcatctgtttacacaccaggaggagagacctcacaagaacccaatcatgatggcactttgatcttagaccgccagcctccagaacagtgagaaaataaatttctgttgtttatgctgtcctgtttaatggtattctgttacggcaacctgagctgactgagacattaacggttccagttttcctggaattgagtggggatcctgggatgtgaaacttccagttttctaacctagaaagtgctgggggcaccagggcaagttggactgtagttctctacccctgctgctctgtctcaaagagccagggtctgcccaggaacaagaagaggaggcaaagatgcctcagccaggcctagaggtgaaagcacaaagcccgaggggctgccaggccgttagacttctaggttcagaggtgctaaggagtgcgtgggacaaaaggctcacggtgattaaggtgaacaatattgttaacagtgcaaaaatattaaggcaaaaccccaatctacaatgaagtaatcatttaacttcgtaaaacaaattccacctgaacttctggagtctctttcaggtccttcccagtgagagtccttgggagttaggggtggtctgggcttctagtcaaatcctgggcttcattcctgttcctctcataggctccaggacctctctctccagccgtctcagggataggacgttaattgttcaagcttcctttttgtccttgctgaccctgcgtacccctacccggcttcagaccaagaggacatgctccctgtgctaccttgtactaaaatgcctgccgggtagagggggtggggaatgggggatgggcagttaatagcatcatggagtctcctctccaggtctgtcttcaagaaaaaaaaaatacccaaaagttgggaaaaaggcaaaaagatgcatgaccttcactgtcaagcttgcacatgggccatgcgactttctagtagaattattatttattctcgattcatgattttacagttctcacagttctcaaaggttagctgttagtttgttgagaagcactaagatacaaagaggtgtttttctttttgtttttttttttgagacggagtctcgctctgtcgcccaggctggagtgcggtggcatgatctcagctcactgcaacctccacctccggggttcacaccattcttctgcctcagcctcccaagtagctgggatcacaggcgcccgccaccacgcccaagtaattttttgtatttttagtagagacggggtttcactgtgtcagccaggatggtctcgatctcctgacctcgtgatccgaccgcctcggactcccaaagtgctgggattacaggcgtgagccaccgtgcccagctgatacaaagagtttttatccaataacagtgcaaataattttttgtcctacagaaataaaaatgtctcctgtttagtagagaagataatcctaaagtttacagttttactgctctgaagaaaaacaatcagcttagtatctaactttgagatcttattctacagttttttcttttactaaccacatttacatctgtttttcttatatacttggttctcccattaatgagttaaaataaaaccttgacatgtactcattatgtatttgtatgaaaatcatgctttttttttttaacattttggaaattagactttttgaagttcccctcactgcacacccatttatctttccctttgaacccacaatgatgtagttctaagtccaagtcttcttcatccttctgccccacaaacagagaaaacctggctctccgtcaaggctgtgctgagtggcacctttgggtaaaaattcttttaaaagaggaattacaggccgagggcggtggctcgcgcctgtaatctcagcactttgggaggccgaggcgggtggatcatttgaggccaggagttcgagaccagcctggccaacatggtgaaaccctgactctactaaagatacaaaaattagccgggcttggtggtgggcgccagtaatcccagctacttgggagactgaggcaggagaatcacttgagcccgggaggtggaggttgcagtgagcagagatcgcgccgttgcactccagcctgggtgaaacagtgagactccatctcaaaaaaaaaaaaaaaaaaaaaggaattactcgttggcagagttatacataagagcaaaatctgaacacttaaatggccagaaatagaaaatagaaaattatggtacatgagcagttaatattacacagctataagcataattatcataaagactattgcagcaacatggcaaatgctcaagctaacgtgttgtgaaaaaagcaatatgtaaaatatgaactggagggaaatcaaacatgaaaatatctattaggaaactttattggttttttttccaagttatatttaatgtagtttttgtcttttcagtgaaaaaaaaaagtaaaagagaaagtttaaaaccagaggaaacagaaaattcatgtgatattgatattccatgaatagttataactgacatggtcatgaaattctggttggaaactttcattgagtaactgtcctgaaatctccccgaactcccccattccatcacccctcacctctgaaaacttaggagctctgaggtcacttactactctgtcatccaatatcatcacggcaaggaaagaccacgtcctgtgaccatagatagagcttgataggatagaacttgaggggtgggcttccaaaggtttgtgaggacacacaaaaccccaactctcagacccatgggcagggatatgagcagctctgccacagagccctgggagggctctcaggcacccttttgggctgtcaagttccagccgcccatccctgccctcatggccctgcccctggtgccaaacattctacctgacttacccatatccacctgtgggccagagaaactcattattcagccactagaccccaaactgggaccccagggcccttacccctttgtccaccttgccttccctctactcagagcatccacgcctgaccacagtgaaaccatcctgaccatggcctagctgtccttttgaggacagacctttccctccctgccctcttggagaaaaccacaaaaacaaatcaggagccagcttagttccaaggggaatgttttcaccctgctcccacttcatgaagttctttggcccagaacacaggaaatgaagcatttatgaggtttcccggaggtatccatgcagcaggaccaagtacctgccagctccgacctcacttggagttgcttttgtttctctggcagctagcgttcttaagctggctcatttaagtgtgtgtatttacaaacagactttactggtattccttaagaaactgcttccttctgattacccgactcagtctctgttcagtgagtcagagtcatatgttgttttatacattggtgtatccttggctattttctaagcacagatcccaagcataagctcctgatgggcagggacatgggtgacatttctttatagcctagcagctaacatagtgccctgtatagaataaatacctgttggcaaagtggaaacaacccaaatattcatcaacagaagaatggatagacaaattgcggtttgtttgtataatgaaatgctactcagtaataaaaaggaatgaaccactgacatgcaacaacatgaatgaacctcaaaaagattacattgaagaaaagaagccagacacaaaagagtacatactacatgattttgtttgtacgaagctctagaaccagcaatactcatctgtatgacagaggtctattataggctgaatgttggtgtatccctccccaaattcctatgttgaagccctaagcccctgtgtagaagtttatttggaaatggggcctccaaggaagtaattaaggttaaatgaggccctgatacgatttgcgtgcttataaaaagaatcacctggctgggtgcggtggctgacacctataatcccagcacttcgggaggctgaggcgggtggatcacaaggtcaagagatcgagaccatcctggccaacatggtgaaaccctgtctctactaaaaatacaaaagttagctgggcgtggtggtgtgtgcctgtaatcccagctacttgggaggctgaggaaggagaatcacttgaacacaggaggtagaggttgcagtgagctaagattgcaccactgcactccagcctgggtgacagagcgagactccatctccaacaacaacaacaacaacatcaacaaaaaagacacctgagagctcattctttccctttccaccagcatgtgctaaggagagccatgagaggacaaagggagaaggtagccacctgcaggccaggaagagagccctcaccagaaacttgactggccagaaccttgatcttggacctagagttcagaactatgaaaactaaatttatgttggtaaaagcctcctagactatggtattttattatggcaacatcaagagactacgatcagaatagtggtgtcttagttcgggctcctataacaaaaataccacagactgagtggcttaaacaatgaacatttatttctcacagttctggaggctgagaagtgcaagatcaaggcactggcaaagccagtgtctgggaagggctctctttctggtttgcagatggcaattttcctgtttaatcctcacatgacagagacagaggttgagagagagaatgcaagcgtgagcacatgtggtctggtttcttttctcttccactaagggcactaatcccatcctgggaagctccatcttcatggcctcatctaaacttaatcacctcacaaaggccccttttccaaataccatcacattggggatggggtttcaacatgtaaattttggagggatacaaatagtccacagcaagtagttacatcaagggaagggttagtgactggcaagggaaatttctagggggaaggaaatgtcctacatcttgatagggtgatggtcacatggatatttacacatgtatgcaaaaagcattgagctgtacacttaagacgtgtgccttttactatctatgaatgacacctcaataaagaactgaaaaaccactgttggcaagaattttttctgcactgtgactcatacctccctaactgatcaatttgggatgaagatttatgaagcacccactgtgtacagattctggcagtaatcacaggtatagcaagagcggggaaaacagcagcagccttggtccctagttctcaaggagcctttttcagctccacagataataatatctggacattcttaagtcacagccactgagccagattgtatcaaatgctaacagctcattaagagacttcttgacacgtgagaagccacattaaccccttcgtgcttccactgaggcagctgttgcctggtccctttgagagccagccagaccctgggttggttcagctgctggcaaataccaccaggaaaaacagaaaggaaatggaaagccagtgcagaaagtgttaatgagattttaaactgtgcaattctgaccttgaggactccctacatctaagcaaaagaagccgaaaaacaatttactcccacatttcagcagttgacttttctgtattgtgcagtcttaatggagttgttagcatcttaggacaaaaatgagaaaatttccccaggtgtttcccactcctttctttccaggactttggcaatgccaatgtgatgtggccagacaccacctcagaagcattgtaaatttggggcaagagctacacgtttcttcccagggagaaaggtgccatttcctttggtgataccagcctctttgcagtaaaacaaacaaaacaaaaccccaaaagtttgcttttataaaatcactacattctagaaaaggcaaacatgtagcacgtgtgccataaacttttctcttgtgtccttagcagacattgttaattgatcacagcattgttaatcactgagcccagttccagaatcagtgatgtgttgagctggttggtactaacttttgagagccagttgttaaattttcttgctacccagttgttaaacatgcccattattaaaaattaaattatatgaacttataattaaatgaattatatgaaagcaaaggtaatggatacacaaaatacatttcctaattattttaccacattttactattacctatggttctgaggttatttacatctatagaatctggaaatactatataatgatgccctactctacatctcttcctgtttagtgatatggtcctggtagcttgaaataggccacaatgacacactgttttacatcacaaaaattggcaaatgctatgatgtggggggctgtcctgcagaccctgacccagcgacagaggaataacatgcaccgacacagatattttgctttgtcagtccagctgagtgtggggaatgcttacagactcccaggagagtgctgtaaacagttgcgactgcagcccccaccagccagtgagactggcatttattcagtaaagattaattgacaaaggcttgagtcaacaccactagagggtaattgacattgcagacctcccaagtagaaagcaattaagcacctgcagtagatcaacggttagtcatgagtaaacaagctagtaagataaactcctccacattcctttgtatctactttaatctatttaactaaaggtaaagggactaggcagccttcagccagatctattaccaaagttatgcaaactctcaggccttccaagagggtctgtggctattataactaaaatttttcccaccagcctgactgaaccctcacactacaagtcaaagcatcccttctaccaacactgagaactaattgttaaacatttaccagcacaccactgcatcagatgacaagagaccctgcagaaagaaggcaaagcatgccaacccaaaccatgctgcctgtgatgggggaaggagtactgatcatcatgcctttccaaacaagacttggcatggaaaaatgtgctgctgagcactagatccagccaagcctgaagccaaaactgctgtacattttaccaatgagacttacctaggggcactgttttctaactctcacaaagacatcatatggactagcagcttggccctggaagggacaggtaattgttttctctggagtcttctggaagggtgcctggaggactcatcccagagcaaccagccaaggtcagtcaaaatcagaagcaaacatgggcataacagctggaggggctggacagaggggtgcagcagagaggcccctagagctgagaggggtgcaggcaaggggtgagactccagagctgatctggaggttcttcccaggaacccggcctggccatttggggtggcagaggctaaaaggcagagagcaggcccagggctcaaagaccctgcactcagaaacggtaatggagatccttttctctcaatttcaggcagtgaaacacatgaaggggaaagtccccacaatctgggccaaatgggggtatcgtaggcagaatctcatggcctgaagctctgcctccagggtcaggaactccaagctgttcccctctcagtttcttctctctctctctcttttaaatttaaagtagacctctgctctaaaatattcaagactaatctgcactatgttcctctaggaacttctcctaaaatgcagatttgggagctacacctcttggaaaggtgattaagcggtttggaagcccctgagatacaacctctttattttattgctggtttttctgcaatggcatcactgccaaaggcagcagaagtcaatgtattggggtggaatggagatagaagggtagctttggggctgtggtggcaggcaggacaggctgcacaatttgcggggctcagtgtcaaatgaaaatgtgggcccctttttcaaaaattactaaggatttcaaggcagtgatggcaaagcattaagacatgggcccttctgaccccagggcctgtatgtaatggcaaaggtcaccccatgagactggtcctggtagctggtcaccagctgcctgtggagatcttatattatctgaatatttataacccaagggatgcccacctgatttttaaggaccaaggctgcagagaaaggcagtgagtcttgcgctgaccccgtcctgacttggaaggagagccgcagtcctgggggacccaacaaagcagatcttcagggtttggggaaacttcactttctcccagggtccagaggctccagatccctggcttggtacctgtttggctctggaatggatacagaaatgtcttagggagataggaacagaagtgaaggaagaccccaaatttggcagctcagctacatgggagaccacaagctgaccgggtcaacctccacagaggactataatcccgccctgcatcccaaccagccctgagtgtctcaggcatgactgtttctcattggtcaagtcatccccttttcactctgatcctgtcctgaaaaaaaaaaacaaacaaacaaaaaaccaaaaaccaaaaactaagaggatgaccaactcatctcagtttgcctgggactttcctgattttagcactgaaagccctgtgatctggtaagcctgtcaaaaaggatggctcgtcaccctagaaaccagtcatagcaaatgtccataggaggcctccttctgaaaaggatggagtcattcctgtggccaggcatctcctaaggttaattggctaagacccaacaattggatacagcaggtgcaactccttcagcatctccaggtacatttttctgggcattccccaggatcttacatcagtcaccatcatgtatagcaagggcatcttactaactgtgactgtagttagtgattggtaacagctgctttgggttttttccacctgaaaaccccatccatgccccaggcagtgcttctcatctctggctgcacattagaataccctgggaggccaagctttgttgttgttcaaaatgcctaaatcattctgacacacacccagggttaaaggcccactgctctagggcctagaacagtggacattttactgcacctttgtccaaaacagcattctgaggtcagtcaggccctgcccagggtctccttcagcccacctccctgcgagtggagggggggcttatacacaggcataaatcctagattaagcatgtttgctttgcaattttttttttggagggacagggtctcattatattgcccaggctggtctggaattcctggcctcaagtgagtttcccatcttggcctttcaagtaatcggaattatggacatgcaccatggcataagcaggtattttaagacccaaaagaatatcagccctgttctattttcttgattatcaaagcatttggcactgcttttgatgatcaatttaaatattttctctccaggttcttgccatttaaagactaaaactctgaaagctcctggtttcacagacaatgatcaggaggctctattgactgtccaattggaatattcttgcactgtggatactgtgagtctgatgactaaccatgttccttcctttacactggctgctaggaagctcagagtcaatttgtagctcacttctaggaattgtacagatttatacttactttgctaacttcatttctgtttttatcttacttcctgagcctactttcccttcaaccccatgtacttagctatttattttgtctgattgaattgaatgtatacaccagctgccacaaatcctttcagaagtgaagaagggaataataaataaacaaataaaatgcaaatggtaatgctattattaggaagaggcagagcttctggtttttgatgcaaagctacctcctcaggttgcaatgcttttctccctgactcatgcagaaaaagtactaatgcccaacccaggaagtgcctttcagccttctctctgacactgtcttctggcctcttcacacagctgtggtagacacttgccttcaacagcacaccatcctccccagtcaaggctatgattctctctaccgggttacaagctcaactcaggactctaggagagtgatttcactgctggggtggagtgttgccatagttgttccaattaatttatttgatttattttcagggttatgagaagggcttttgatatcaatatgcaaatgtaatttaaaacttaaatcaatattctgaaccaagagcatgggcatttttaaccggaatgcaggatagtcttaaatgcctgaagttacagctctttgtgactgatgacttgattctccatggagttttatttgcagatgccaggaacttggttattccaagagctctattgttcagaaagcaaggaggctatgtagggtgttcaagatgtcttcactttcttccagctgcatgactattcagaggttctgtacaaatggctaaggcaaaccctccatattataagcaacatttacaactcagtccatgaactgtatgcccactttccatcatagaatcctagtgctgaaaattatctgggtgaacatccaatgcagccctttcatttgatgaataaataagctgaagggacttgtccaggatccacatagggaatgagtggcagagtttggactgggatccaatcccactcacaactctgaccaacccagaatcaggcgcataaacttcaattctagcctcctcagacaagcttaccagggatttcctccagtcctactctacttccaacctacttcatatattcaaggtaccctcctgatgcattctatgccccaaaccatctgaatatacggccttctgaacccataattgaacatgaggcctaactgaaggctcccgtgggcaatgggaactctgtgtaggggaactcagccttgcctcctctctcgagtcagggaatgcctacattctggaccgatgaacaccttgcttattagcaagttttctccagccttgcacattgcctctttcagggaccatctcatgtttccaggagagtacatgattttcaaaagccccctttagagacagtcccacccttgcaaattggcacacagtacaaagaacattcaaggagtaaagcccagcccacgcagctcagggaccgttgccctccttgtcctcctgagactgcatttcctacaacacctcacccttccccttccaggtgctctgcgagtttggggagaggtgtttggtaaattgacagcatctggatcatatcagagatttaaatgtcaagctaaagatattttctagtctttcccagagggctaagatttgagtgctcatcaattcatctcctccctaactacttggattttacactgtaaatgttcacagattagttgtttctagtgcctctccatctcaaacggtaaagtggaagcgctcaggccccaccaagctgccaagaagtcaggagctgtaggcgtgtgacccattgttttggtgttcaagattatagtaacgctggctggagtttatttcacacatccaccctgctgtctctggctctgatccagcctacagaagggaggcagaagatctttttaaatgatggtaaacaatgaggtcacagcccagaacagcccagccctcctggccccagccaagaaaacacattcttaatggttacaggagccctatggtttgctctaagtcaaggagtcatggctggtaggatgaaacagactgggactcacaaattaggagatccacttaagggcagtggcttggaactgaagaattctcacgagtccccagatcaggaccccaggctctaaactctagcacctaatgcagtacccagcacatagtaggtggtcaataaccccaggggccttcctccctgggctgtaattccacaacccaacacagcacctggaacataattggtagtcaataaatgttggtgaattattgcattcataaatcaataactggatggatagatgtgtggaaggataaatggatgattcgatgaatgttgttaaaccttgactcaaaactatcaagtcaaaaaagtggactcagctccttgcaaggcaattcctttatgggttgaacccttactcttattggcacaaaattctcccactgattgaaccaaaatctaccatattgtaccttgcccttggcagttctagttttctcctatctttctgctctttctagagagaactttctttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgtgcccggctaattttttgtatttttagtagagacggggtttcaccgtggtctcgatctcctgacctcgtgatccgcccgcctcggcctcccaaagtgctgggattacaggcgtgagccaccgcgcccggcctctagagagaactttcaaaggcaaagcagaccccttctgcattctcattctcttcagtagcattagaaactagtaagaaatgccgtattttttagctgtagaatcacaagggtaaacttgaggaaatcaacaagtctttatttcctctaagactccaccggttctggttttcccatgcatgagtggaatgttgtatctgaagagtcctaggtctgggtccttgctccctgtaccaacagcagccatctctatatcaagatggcagccacagaacaccgaagcccctggacacttcagtgactttgtagtgtgtcaattagctaggccaacctactctttccagaatcttctttcgtatgtgttttcagttagagtgggtatattttccccagttcagatatttgaaaggatctcctaggctctacagagtatactcacataaggcttttatttaaaggcaacagggaatgaaagagaatgcagggaagcagtgtaggtctgacaggcattctgcagcaccaggtttgtccacaagggcccaatctttgtgcccacagcccatgttgaatctctggattgaactgccaagatctgtgctaggaatcttggcttcaggagaacccactgcaaagagctatgtggctctgtaagtaggcaagtctggctgctcaaactagtgaggccaggtgcaaaccaccaataaagaagataacactgcggattgccaggggagtattggaccttaaatagtacatcccttgtcccactgcccttgtcttggtcaggagccaaaaaccaaacattgaagtatccccagaaataaaaatagagctttgccagtgacatggtttggctttgtgtccccacccaaatctcatgttgaattgtagttcctggtgttggaggtggggcctggtgggaggtgattggatcatggggtggtttctaatggcttagcaccatccccctagtgctgtcttgtgatagagttctcatgagatctggttgtttgaaagtgtgtagcacctccccctttactctctctctctctcctgctttgccttctgccatgactataagtttcctgaggtatccccagaagcagaagcctgtgcaacccacagaaccatgagctgattaaacctcttttcttttataaattaaccagtgtcaggtatgtctttatagccgtgtgagaatggactaatacagccagtatctctatggtggaacccaagagagattcttgggagattagaagggcagagggaagcaagagttgttttgcagctcacacatgttgctgatctgctgactcgcctcattggcaggaagccactgctgggcctgcaagtgctttatcttctcctggatcctccttcagtttccgctttctgggccagccatctatgtttagctctatgacagaaggccccagcttctccaagacacccaaaccacctacatcagaggcaacaagaaaagacacgggttttaattcatctttgtggggctccaccttgtacctatggattccaacttgttcttgatctctccactctgtgtccatctttccttcccaactgcatgccctgtgaacttaaagttacaacatcacatgtgaagacaataactttccagaagctacttaaccagttctcatagtgatgtaaggacatatctctgtaacaaatctttaaaaaatgtgtctatgtatctatctatctatctatctatctatctatctatctatctatctatatctatctatctgtatctatctatcatctatctatctatatctatctatctatctatctatctatctatctatctatctatctatctatcatctcccagtggctctgcttctctggttgaatcctgacccctggctggtacaggtaccctgccaccttctgggagcctagccattgacatcttcctccttctgtgttgcagaaaatgccagatgttggccaattccctaggtgctgcctctgtgaacactgccattcaaattgtaagctccttcagacagtctctattctatgtgcaggtggaagcctgggcaggcagccctgttcttcactatggagtgggctacatagacttgcagatgccagatagcccaataaactcagctaatttctcacaagagggaaaatgccaaacagtgataagaaataactgaagaagtccactagccatgaaaaatagtgattcttggatatctaataaaccttgagacaggagagtaaggtaagatcactagacagagacaggggtgccttgccatatggatatcagggccaacttccagggcatcccttggcactcacagaatgccccagtgtgcacgtgatataaagatatattttctctggactcaaacccaacaggtggagctttgcacatctcttatcagagaggttgcaaattggcagactgtgggctgaagttggcctgccaatatgttttctttgaactcaacagtgtttttaaattttttgccaacttccacaaattggggatttcacatttaaaaaaaacaaaatttcccacttttcttgaaaaaatcagaaggtttggcaagtatgggccttttttcctgcgtggcaaaaattggctgtagctgagtaacagctgctcttgttaaacagggatagaactctctagctcatgctgttccacccaacctgcttctcttgcttatgttacctgcctggcttctggaggcatctaagtttacaagcactggtattcccatctgtagcagatgctgcctggcatcctgctcatatcctttcccattgcagtagaaacccaagctggacttcaaactgccaggatctgcacctttttacctgaggactttctttggcagccactccctctctggttgctccccaacaggtcataagtgcaccttctcagcagtcttcaactgataggagttggtgtataaataccctagcttccttcccgttggttggaataactctgaggcacaaaatcagtaccctgattttcagagttccccaatgctattaagttctagatacccacaatggtagctgacttgataaaatgccctttaaaggctgccttatcctccctatctctcctcccctctcctttgccagtaatttttttaaccgcctgaataaaccacttatacattttattgtacagtaacaagaattcatagtacttatgttctgtaaagttgcatgaacactgaattagcaaatactgaacaattgttcctaggagaaatagagggttaggttcctgtgagcttccagtcacaatatttttgtcagctaatcaatagataaccttgttttaggtatgtctatgtttaaagacacctaaattaatatatattattaattcattggcgttgaactcatggccaacaacactatgacttatgcctaaatgaagctcatctcacacatgtattttctgtgtgaggcacattgtagccttcttttgctcaggagcactagacagccttcagcactacatatggggaccattttaaacatcaaaataatcaataaaaagcataaaaattggaaaaacatggtgctatgcagaatatgaaaaggacacttgtttacaatatgaaagctgaaacgtgaatgcagagtatcgctttgtttgaccttagctgagaacatgcacattgagttactcaagttttttgctgctctgtgcatatccataatcaactgtgaaagtgccaagaatattgattctggaagttacaaattaattttagtgagtagacaagtttgtaaatatgaaatctgttaacaaagaggatcgactgttccccagaaactgcctctagggtacctcaaatgaggacattattagaagtgctttctcttcaagtaatttcctcttcaaatattcagtatttgtaattcagaaatatacacaactgggaagaaatataacacagtggttttcaggcattggccagtaggtagcaaaggtaatgatccctgagagagagaaaacaaatgaggcgagtcctgtgatttacccagtgtattgcctggaggcagttacaaggctatagtgcaggaagaaggaaaccaggtggaacttagtggttcccctgagttgaagagactgagctggaagtctggggaggtcaaggaggttacagtttgtagttctgaagagtagagagctacacccagagagagctccagtgatttgcagagccttcatatgagttctgatcagagcaaacatgtgaagcaacaatgcaatgtgtgttctgggaaaagacccacctgaaaggagcagagggaataatcctaagagctcacggagaattaggtttagttagtgtttccaccagtcaaagtggaaaaccctgtacttcatggggcatcagatagagtgagagggtcttgcctcggtggtggggaaaaaattgacccttaactaaagactgctcaaaaaatcaagctattttccagtaacttaactatattctagaacaaaactcaacaatacttacaggaaaacaaaaatgtccaacactcatcaaggtaaaatttacgatgtctgacatcaaattaaaaattaccagtcatgcaagaagcaggaaaagataacccataatgaggagaaaaattaatagaaacagatcaagaaacgatgcagatgatacaattagtagacaaggacatttaaactattattatattttacacgtttcagaaagtaaaggagacatcgagcatgttaagtagagacatggaagatatatataaaaaaagattcaaatagaacatctagagagaaagttagaatgtctgagacgaaaaatacactggatgggattaatagcaaattagatactacagaagaaaagattagttgaattgaagacatagcaataaaaactattcaagatgaattcagagaagaaaaaagtaagataagtcaggagctttattacagtatggcttctaatggctcatcattcgagtctgtccctggaaccttactgacacacagtgcttgtggcccttgggagggcacagaagggaaagctggacaaggggctaagtttcctagatacagtgcgaagcagaagtatgaggctcctgcccaggctcaggctccagatgtctccaacactctctaactttcctctttcaggccttagagatttggtgggtagctgcttctacctgttatattttaagaatataggccaggcgcggtggctcacgcctgtaatcccagcactttgggaggctgaggcgggtggatcacgaggtcaggagattgagaccatcctggctaacatggtgaaaccccgtctctactaaaaatacaaaaaattagccgggcgtggtggcgggcacctgtagtcccaactacttgggaggctgaggcagaagaatggcgtgaacccaggaggcggaatttgcagtgagccaagatcacaccactgcactccagcctgggtgacagagtgagactccgtctcaaaaaaaaaagaaaaaaaatatatttaaccgacaaataagaattgtatgtatacaatgtgaaatttgatgtacatatacattatctaacaattaccacaatcaaattaattaaaatatccatcagcatccatagttatcatttgtgtgcatgtgtgcgtgtgtgtgtgtgtatgtgttgagaacacttaaaacctgctctttaatccaattttaagtaaacaatacagtattactaactataaccaccatgccatactttcgatccccagaacatcttcatctcacaactgaaagttcgtacccttgatcaacatctccccattgcccccacccactgccccctggcaaccatgtttctactctctgcttctatgggttcaactttttaagatgagaccacacacttttgaaggatgttcttctgaggaattaggaaagaatggctatgaagtttcctgtctcctcagttctttgctcaatttttgtcctcctataaacatagtttctttctgttttaagacttgctactcttaaaacagaataacaaaataaagaaatcaatgtcttaaatattacactaaattttcatagctcttgtttctctctttaaaaacattttttttagagatggggtctttctatgttgcccaggctgctctcaagcttctgtcatcaagcaattctcctgcctcagcctcccaaagtgctggggttatgggcacaagccactggacctgtcttatagcttctgtttctattggatgataaaatataaaatcaaggatgggtttgcctttctcagcagcttctctgagcttttgtcttaggccatttttagtgctatcactgaatgccacaaactgggtaatttataaagaacagaaatttattggcttacagttctggaggctagaaagtccaatatcaaggtgccagcatggcaagcgccctctttctgcatcaaaacatggcatcaggcaccacacagcaaagggcaaagagacagagagagcaagaaggggtgaacctactcccacaatagggaacccactgccatgataaaagctttggttcactcatgagggtagagaccacatgatctcaacacctcttaaaggttctatcttctaattctgtcacaacggcaattaaatttcaatatgaattttgaaggagacaaacattcacaccatatgagcccattctcagacattactaaatacaccctgaataaatgctggggtcccgcacaaaagaatattaaaacctcaataagacaccactaactttcttttaattataaactatttcaaacatactgaaaactatatagtagacacccatatatttatattccaagtttttaaaaagttgataatttgttgtatttgcatcagaactttcaattaatattttgaagttatggatatatacagatataaagatgggagctaaagcctcctttctccccttctggtctcttctttccctccattcccagaattaatcatctcctgaaggtgtttttctttttaataattttatatattatcatatatgcttaatatggagtatcattttgattattataacatttacataagtaatatcacaccatccttttgcaacttacttttttcactcggtattatgttttagaaatttatatgtattgatttgtgtagatttagttcattcattctaactgctttattttatgatgttacatgaacatttagtaatttcatgtgtttttgctattacagtggttcagtgaacatccttgcaaatgtctcctagtgaacacgtacaaaagtttctcccagaagtagaaatgctgtgttatagagcgtgtgtgtcctcagcattactgggtattcccagaatattcatcaaaggataccaatctacactcctagcaacagcacagaagcagtcccttttccccacatctttagctgaatcactattatcagctttaaaaaatttgtatcaatctatatctagactctctattctgttccgttgatttgcttctcaattatatgctaataccacactattttaatgattatagctttataaatctagatatctgctaagagggatttacctccttgttcttcataattatctatttattcttgttattttattcttctgtaagaattgtaggatagattgcttgttgtattagtccgtttttgcactgcgataaagaacttccccgagactggataatttataaagaaaataggtttaattgactcacagttccacacgaccggggaggcctcaggaaacttacaatcatggcggaaggggaagaggcaccctcttcagaaagtggcaggagaaagaagagaaagcaaaggaggaccagccctgtataaaccatcagatctcatgaaaactcactcgctatcatgagaacagcatgggagaatcctcctccatgatcaaatcacctccctctccctccacaggtggagattacaggtccctccctcaacacgtaaggcttacaattcgagatgagattcgggtggggacacagagtcagagactatcacttgtcaaaatctatggaaagctcagttagcattggaatgtaatgacagcgaatttctagatgaacttgggaaaaattgacatctttttcatgtagagtctttctatccaggctcatctatgtctctccaggtttactttgatttttcaataaattttatagttttcccatatatggtgtaagatttattaccaggcagttagaatttttgttgctgaaatgccacttttcacttaccagaaaggagaagatcaaaaagattaataacactctccactggtaagattataggaaaatggacaatctcataatttattagtgtaagtgtaaattaatacaatctcttggagaataattttaatagctctaaactttttaatgcatacattatttgagacttttcatttctagaaattattcacaaatatatgcacaaatatgtaaaatgttttgtgtatgatattaaggcagtataattctaaaagtataaaattggccacaacctaaatgtgtatcagtagaagcttggctaaatcaatcattgattagttgatctgttcaataaaatattatgcagtcattaaaatgaggcagctttataaatacttatatgaaaaaatatgcaagattttaattttttcttttttctgtttgctttagatttactttgctcttctttttccggtgtcttaaggaagtaggttaggttattgatcagaaatctttcttctttcttaatataagcatttgcagctataaatttccttgtaatactgctttagctacattccatacgttttcttttttattattatactttaagttctagggtacatgtgcacaacgtgcaggtttgttacatacgcatacatgtgccatgttggtgtgctgcacccattaactcatcatttagcattaagtatatctcctaatgctacccctcccccaggcccccaccccatgacaggccctggtgtgtggtgttccccaacctgtgtccaagtgttctcattgttcaattcccacctatgagtgagaacatgcggtgttcagtttgctgtccttgtgatagtttgcttagaatgatggtttccagcgtcatccatatccctacaaaggacatgaactcatcattttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaatgggatggctgggtcaaatggtatttctagttctagatccttgaagaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcttttctctgatggccagtgatgatgagcattttttcatatgtctgttggttgcataaatgtcttcttttgagaagtgtctgtttctatcctttgcccactttttgatggggttgtttgattttttcttgtaaatttgtttaagttctttgtagattctggatattagccctttgtcagatgggtagattgcaaaaaatttctcccattctgtaggttgcctgttcactttgatggtagtttcttttgctgtgcagaagatctttagtttcattagatcccatttctcaattttggcttttgttgccattgcttttggtgttttagacttgaagtccttgcctatgcccatgtcctgaatggtattgcctaggttttcttctagggtttttatggttttagatgtgacatttaagtctttaatccatcttgaattgatttttatataagatgtaaggaaggtatccagtttcaggtttctacatatggctagccagttttcccggcgccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagcatagtttgaagtcaggtagcatgatgcctccagctttgttctattggcttaggattgtcttggcaatgtgggctcttttttggttccatatgaactttaaagtcttggtagcttgatggggatggcattgaatctataaattaccttgggcggtatggccattttcatgatattgattcttcttatccatgagcatggaatgttcttgcatttgtttgtgtcctcttttatttcgttgaacagtggtttgtaattctccttgaaaaggtccttcacatcccttgtttggtggattcctaggtattttattctctttgaagcaattgtgaataagagttcactcatgatttggctctctgtctgttattggtgtataggaatgcttgtgatttttgcagattgatttcgtatcctgagactttgctgaagttgcttattagcttaaggagattttgggctgagatgatggggttttctaaatatacaatcatgtcatctgcaaacagggacaacttgacttcctcttttcctaattgaataactttatttctttcttctgcctgattgccctggccagaacttccaacactatgttgaataggagtggtgagagagggcatccctgtcttgtgcccattttcaaagggaatgcttccagtttttgcccattcagtatgatattggctgtggatttgtcatcgatagctcttattattttgagatacgtcccatcaatacctaatttattgggagtttttagcatgaagggctgttgaattttgtcaaaggccttttctgcatctattgagataatcatgtggtttttgtctttggttctgtttatatgatggattacgtttattgatttgtgtacgttgaaccagccttgcatcccagggatgaagcccacttgatcatggtggataagctttttgatgtgctgctggatttggtttgccagtattttattgaagatttttgcatcgatgttcatcagggatattggtctaaaattctctttttttgttgtgtctctgcccagctttggtatcaggatgatgctggcctcataaaatgagttagggaggattccctctttttctattgattggaatagtttcagaaggagtggtaccatctcctctttctacctctggtagaattcagctgtgaatccgtctgatcttggactttttttgattggtaggctcttaattattgcctcaatttcagagcctgttattggtctattcagggactcagcttcttcctggtttagtcttgggagggtgtatgtgtccaggaatttatccatttcttctagattttctagtttatttgcatagaggtgtttatagtattctctgatggtagtttgtatctctgtgggatcggtggtgacatcccctttatcattttttattgcgtctatttgattcttctctcttttcttctttattagtcttgctagcagtctatcaattttgttaatcttttctaaaaaccagctcctggattcattgattttttgaagggtttttggtgtctctatctccttcagttctgctctgatcttagttatttcttgccttctgctggcttttgaatgtgtttgctcttgcttctctagttcttttaattgtgatgttagggtgtcaattttagatctttcctgctttctcttgtgggcatttagtgctataaatttccctctacaccttgccttaaatgtgtcccagagattctggtatgttgtgtctttgttctcattggtttcaaagaacatctttatttctgccttcatttcgttatgtacccagtagtcattcaggagcaggttgttcagtttccatatagttaagcggttttgagtgagtttcttaatcttgaattctagtttgattgcactgtggtctgagagacagtttgttataatttctgttcttttacgtttgctgaggagtgctttacttccaactatgtggtcaattttggaataagtgcgatgtggtgctgagaagaatgtatattctgttgatttgggttggagagttctgtagatgtctgttaggtctgcttgttgcagagctgagttcaagtcctggatatccttgttaacttcctgtctcgtggatctctctaatgttgacagtggggtgttaaagtctcccattattattgtgtgggagtctaagtctctttataggtctctaaggagttgctttatgaatctgggtgctcctctattgggtgcatatatatttaggatagttagctcttcttgttgaattgatccctttaccattatgtaatggccttctttgtctcttctgatctttgttggtttaaagtctgttttatcagagactaggattgcaacccctgctttttttttgttttccatttgcttggtagatcttcctccatccctttattttgagcctatatgtgtctctgcacgtgagatgggtctcctgaatatagcacactgatgggtcttgactctttatccaatttgccagtctgtgtcttttaattggagcatttagcccatttacatttaaggttaatattgttatgtgtgaatttgatcctgtcagtatgatgttagctggttattttgcttgttagttgatacagtttcttcctagcatcgatggtctttgcaatttggcatgtttttgcagtggctggtaccggttgctcctttccatgtttagtgcttccttcaggagctcttgtaaggcgggcctgatggtgacaaaaatctctcagtatttgcttgtctgtaaaggatttttatttctccctcacttatgaagcttaatttggctggatatgaaattctgggttgaaaattcttttctttaagaatgtcgaatattggcccccactctcttctggcttgtagagtttctgccgagagatccgctgttagtctgatgggcttccctttgtgggtaatccgacctttctctctggccgcccttaacattttttccttcatttcaactttggtgaatctgacaattatgtgtcttggagttgctcttctcgaagagtatctttgtggcattctctgtatttcctgaatttgaatgttggcctgccttgctagactggggaagttctgctggataatatcctgcagagtgttttccaacttggttccattctccctgtcactttcaggtacaccaatcagacgtagatttggtcttttcacatagtcccatatttcttggaggctttgttcatttctttttactctttttttctctaaacttctcgcttcatttcattcatttgatcttccatcactgataccctttcttccagttgatcgaattggctactgaagcttgtgcatgtgtcacgtagttcttgtgccatggttttcagctgcagcaggtaatttaaggtcttctctatgctgtttattctagttagccattcattcattcttttttcaaggtttttagcttttttgcaattggttcaaacatcctcctttaccttggagaagtttgttattaccgatcttctgaagccttcttctctcaactcatcaaagtcattctccatccaactctgtttcattgctggtgaggagctgcattcctttggaagggaagaggcactctgattttaagaattttcagcttttctgctctggtttctccccatctttgtggttttatctacctttggtctttgatgatggtgacatacagatgggattttggtgtggatgtcctttctgtttgttagttttcctactaacagtcaggacccttagctgcaggtctgttggagtttgctggaggtccacttccagaccgtttgcctgggtatcaccagcggaggctgcagaaccgcaaatattgcagaatggcaaatgttgctgcctgatcattcctctggaagcttcatctcagaggggcactggccgtatgaggtgtcagtcggcccctactgggaggtgcctcccagttaggctactcgggggtcagggacccatttgaggaggcagtctgtccgttctcagatctcaaactccatgctgggagaaccactactctcttcaaagctgtcagacagggacgtttaagtctgcagaagtttctgctgccttttgttcagctatgccctgcccccagaggtggagtctacagaggcaggcaggcctacttgagctgcagtgggctccactcagtttgagcttctctgctgctttgtttacctactcaagcctcagcaatggcagatgcccctcccccagcctcgctgctgccttgcagttcaatctcagactggtgtgctggcagtgagcaaggctctgtgggtgtgggaccctctgagccaggcacgggatataatctcctggtgtgccaattgcctagaccattggaaaagcacagtgttagggtgggagtgacccaattttccaggtgccatctgtcacggcttcccttggctaggaaagggaattccccgaccccttgcacctcccaggtgacatgatgcctcaccctgctttagctcacagtccgtgggctgcacccactgtcctgaacccactgtctgacaagccccagtgagatcaacctggtacctcagttggaaatgcagaaatcacccatcttctgcgttgctcacgctgggagctgtagactggagctgttcctgttcacccatcttggaagctcccacattccataagtttttagcctgttgtgtcttcgttttcttttatttcaaagtattctctaggttctcatgtgatttctcctttggcccattagttatttggagtatgttgtttagttctcaaatatttgtgaattactcaaatttctttctgacattgatttctatttcattctattttggttggaggacacactttgtataatttaaatccttttagagttactgaggattgtttaatggtttagtgtataatctctcctggagaacattccatgtacacttgagaagaatgtattttactattgatgggtagaagaaagggacacctcttaaaatctcctttctctcatatcttactctctcttccttacagttatttcacagcatctcaccctctaagcttgaactctcttcctgtcatgcccagtccatagggtgttctttgtttttctccttcttcattctctctcacctctttattatataatcaacttagcctctcctatgatggcttctcctcctcttcttccttttcctccttctctttgttccccaggttttcattattcagattctcctagaacaaaatagaacctgagaactgaccccaacataagaattctccccctttccccatgcctctttaatttaatctctctttacaaatttttctgaacctgcattgcaaaaagtacaagaaccagcctggcaaggagagaactctcaatatgatcagatcactagggttaaaatgaactggtgaagacaaattttccttctacatccaccttccatggatcacagaccccgtgggagatccttgtaaacaaagtcttaatcaaccatagcaggattatcctcctgcctcaaagtctcccactgtaaattccatctcagccctctgtgtacctaatggaaccaaatgtgaagctttgatagtggcaacctcaaagctggaatcaatttagcttaattcattattgatactctactaaaaagtccctttgaagtcacagcatcagcagatgccacaaacattaagatccctcacagttgtctaagctcttacagcctatggaggggtggaaaggtaattgcacttttgttgaacaaagacttagaaaaaatatcagatatttgtattttatttttcgcatattaacccagatatttgtacacatctctatgattgctctcagcacattatatggctgtaattatttgtgggccttactggctgtatcttattcatctttttattcccttgctaagcactatgcctggcacatagtagaaattcaataaacatttgcagaatgaatggagacaacacaataataaatagacccagtagggcttcacagtgcttttccaaaagaatatttataggtactgaaaacccactatattggtatcataactcaaaatctatcccaagccctgtgttatttttttttcaggtatagtcccaaaagttcagtggcattttcaatcccttcaatcctactttcagccagtgtaattattggcaaagcctatttcaaatgtgtgctacagatgcacatgtgtgcccacacacacacacacgcacacatgcacagccgcatacacacacacacacacgggctacacattttgtaatctgagcatagaggatggtgcactcaccctgccttctacaccaggaatggacctttattctaagaattagagggataatgaaggacagagatgcacatgtctcctaaacctctcagaccttcaaagacacctggacctcaaatgaggggataagatttttgaggtacttatatattttgttgtcataatttcttctgcaccctagccttttctttattctgacaactggcattactggtcttccttgcttccagaaaagaatggcattgcagaatgctgatagcattctatcagaattgaatgcttggcttttgaggttcagaacactagatcaggacataaataaaaaattggtaagaatacctgaagagcaacaacagaggctccctgttctgtgcaagggccagaggttccctgagcagagtctgttgagagtgagactatgacatcgacagtgtctcatgtcacccagtgagggctcatgtggccagccttagggtggttacaataagaatttttgtctttagttcagcagaacaagagaatcattgatggctgaaaagatggaagaaataacgagagaatttctcctggagtgtcctcaacatgaaactgaaaggcataccacctaaattttttggtagtcattcttccagtacatttgccactgggagctggcaggagctttctgaagttttgtttctaggctcaggaagatgttgatttgggtcatggccgttgtccatatctaggtcattccagaaggcactgttaggggtgctcttgcctccccatgcccctagcaggctggatccacatggggtgagcatagtgtcattacctccctcccagtgtgacactcacctggcattagtgagcagtctactgagcaaaagacgtagtttcctgaaaaactgtccttagaagaaaaagtagaattgagtgattagaatcaatcctagaatcctgctagagtcactgggattgactgggtttttagaacaggttgactttataatgtcaggtatggctttgatttactctttagcatattattctaggcataatacagaatatactgaagaatgtttgacttctgttaggactttaaatctaagagagtactaattacataattacacactttactgcacagaatacagatccgaaaacttgtcatagtccagtttatataaaaaaaggagaaataatcttgctgaataccataggaagttatttatttcaccgagtaacttactccaccagtataaataaaaaaggagataaattatttatattggttgatacctgtgtcttcgtttgggttcccctgaaagcaaactctgagataaaagcttggatgtagacggtttatttagaacagaacccaagaagtacaagtatggagggggggaaagtaagaaagagacagtgaataaaggaagcacgcatgaacaggttaccactgtggacaactgggtcctcagtcctgccaggaactctagaaatcctagaactctaagaattctggagaattatgtaaactctatctcagaatagtcccatcaagcctattcactattacccactattacctactgaaatatttatccaccagtttccttttcttaaggattgaagttgttcctgaagttaaatccctagcacttctggcctgctctgcatgaacggtgagccactccctcatgctggggaagccctcaggcagagagatgcaggccccggaggtgggaagctatttctgcgcacagttactgtccatctgcagctgcacatgaactcagagctggggcagagggaatagagagcagtgcatctgccatggctgctgcaatctctttgggaattagaacatttctaaattcgcgtatgtcttttaagtcccctatgccgggagaggaattgttgaagagaaagcaaaaagactttagattctggtgggtccctgaaaagtatcctaaactgctctgctaagccaaatcccaggacagaaatgatataggaaggtaaatgacagtaacccccaatagtgtccccatcttttacagcacagggaaatgacaagatcccagaatctccttcaaatagcatggtgtgggagcagaagaaacctcttgggtgtttaggctggtgggtgtaaggcagcctcaaagagtccctcattcccctgagaagagggatgtgggcatgtcacagaagttgtgacccacaaaggccttgggtatggagagcaggtggatgtagcaaaacctttccagagaagtgtctggagaccagatggggacagagccctttcagagactctgatgtagatgacaaggacaaggacaggtgcctgggccctgtgggacccccacaaagtagaccttgccctgcggagaaagtgaatggtgaaaccttgaacctcctgaggttggttttactaccaaggagaaggggttcatgaattcacttacagtgaaaataaaaactttcatctttccttgcacatctgagcctatggcctccatacacatggaacaaagctcctttgtttccctctcatacccaagcagaacatttcctgggaccagagagaagcaacttgagtgtgggcccctttcttgtcatgtaagggagatgtgttctttacactagtgctctaagaccttagcatacattagaagcattcagagggcttgttaaaacatagaagcccaggcccacccccataaatactggctcagtaagtctgagaaaggcctaagaaggacctttgttcttggttaccttttgatatggtttggctgtgtccccacccaaatctcatcttgaattgtaactcccacaattcccatgtgtcctgggaggaacccagtgggaggcgattgaattatgggggtgggtctttcctgtgctgttctcacaatagtgaatgagtctcatgagatctgatggttttaaaagtgggagtttcctgcacaagctctcgctctctgcctgctgccatccatgtaagacatgacttgcttctccttgtcttccaccatgattatgaggcctccccagccatgtggaactgtaagtccattaaacatctttttcttcccagtctcaagtatgtctttatcagcagcatgaaaatggattaatatgcccttgcattcagtgatggccctgctggtcatagctgtgcacagagaaggcacttcaggcactgcggacaccaggcctcttcatgttagccctgtgtaaaagccattccctgcccatgcttgcctctgtgccatttagacacacagtaagatcctactctgtagtgctgttccttcacaataaaatccatagccagatcatgaaagaggaaagagagagtgggctaggctaccttgggcagactgagggaagggaggagttggggttggtcatttgcataagtggttgcatgccatccatttcccttcttccctttctgaggtcctagggtgttaccttgttgttaagaatttatttattgcataatgcatagtgtatatcatatcactcatctctgagagtcatttattggacaaccatgtgttgccgggccaggcactgtgctgagtgtgagagagacaaagacggaacaaccactaatggaggagaccaaaaagcaaacagccatcactgtgtgttatagctgtctcagtccatttgtgttgctgtaaaggaatacctgaggctgggtaatttataaagaagtttatttggcttgcacttctgcaggctgtacaagaagactgtgccaacatctgcttctgatgaggacctcaagctgcttccattcatggtggaaggcaaaggggaacctgcacctgcagggattacatggcgagaaagggattaagcaagaaatgggggcgatgccagcctccttttaacaaccagatgtcacaggaaccaacagagtgagaattcattcacccggtctccctctgctccaagcaggaaattcacctattcatgaaggatccaccctcatgacccagacacctcccattaggccccacctctaacactgggaattaaatttcgacatgaagtttggaggaacaaacattcaaaccatagcaccaagtcaaacaaaaaaatgcctggggttaagttatttggggaattgcctctctagcttcccttattcttgctcttttcacctcagcttgagatgggaagaacagcgactgggccgttgatgacatcttcttgaattgcttgggccaggtctgctattgctttgcagaattttttgtttttcactagctgatgtctactgttcctttcatgaatactctcagtctctgatttgttctggcactttaacctgccatccatctgaacagaaaaatttcatttttttctaggaaaacagcagaattgttaacaccaaagctgccatggcttatgagaaaacagacagatgaaaagctaaagagagaaacatacagaaaccccagtggcggtctaattggggtgttgatcatctcacctctctgagcaatgagacagcctggaggttagatcaacaatgctctgagtcccaggagagacccacggcctgcatctgggacttcaccagatctagtttatcttgaactggagccaagaatcccaggccagagtcacccagccccagttcttttgggagccttttttcatgggctgtctctgtcatgggaaggccatgggctgaggaggttagtgtgatgcctaacctcactagaggttgaggaaggagatggaatgggagaaggagagatggaaatgacagagctagagcaagagttgagagaaggcagaggagggtgggagggtggggagggcaagaggaactgtatccgtttcctgcggctgccataacaaagtcccacaagtgggtggcttaaataacagaaatgtatgatctcacagttgtagcaacaagaagtccatgatcaaggtgttggcagtgctggttctttcttaggactgtgaaggacagtctgtttcatgtctctcctagctatcagtgatttcctggccatctttgatattccttggcttttagatgtgtcacccaggtctgccctcttcttcacatgatgttctctgtgtatgcctgtctctgcccaattgtcccctttttgtaacaataccagtcatattagattagggcccaccctaacaacctccttttaacctgataatctacaaagatcctatttgctgtcaaggcccccttcacaggttccccagcagaggcagggcttcagtgtaattttggaggacacgattcaacccatgataggagcaagggtgagaaagagaggagaagggagcaaggtctgggcctcatgtgccaagtgatggtgggggatgggaagaactggcagcaaagctgtcagggacagcagcaaaggcctggggagtggaaaaatgtgctttgtgtactctggaaaaacagcagtgaacaagcaaacaaaagccctacccttgtggagcttatgttttatgggagtgggtggagaaacagacaataaacaccttagtattttaattttccaggtgttgagaagagccacagagattctcaaagaaagccccatgttgatgaggggtttcaatgtagaatggggggtccacgaagccttcactaaataggtgacattggagtgaacacaaaaatgaagaaatgagccacatggatgactttctggggaacacaaaaatgaagaaatgagccatatggatgactttctggggaaagagtgctcaagcagtgggctggccagggtgacagccctggggtgggctgttcttggtaagttcaagcacagcgttgctagagatgagtggaagatggtgactctgcacactcagttttctgaaggcctcctggatttggaaccttctaatccttcatcctcattaacctcaaaatgtccccagatattctgaactacatctcccagggtgtctgcctcttgaatttggaaatgacacagtattcccacctggcaatacaccgtgatttgagatttggaagacacaattcaatccagaaattgctaagcactgtccactggggcattacaatgggattccaggagaacaaccacacataacccactatttcacctctgacttcatgaaaacacacgtgtatacatgcttgtgcacgtgagtgtgcacagacacaccacacacactggaagaaacaactgagtcaaaaggtaaaacatttttttccacaaacattttagctgacattctaagatcaaaataaagacaaaaacaatgagcaagttcattgcaggacttccccaatggcagttttcccccctccactcttggttgcagacagcatggctgctttacagccatcagaagaaacactgctcatggtgatggtcagctatccttcaacctgttcaagccagaagcctgaaaactgagcatgctggattctcttctcccttctacctacctcactccctcagtgatctcaggtctcacggcttcaaacactatctgagtgctgctggagtccagctttgtatatgcaggccagacctccccctgaccttcagctatcctacaactgctgccttcacttcatctcctcttagctgtctagaggacatctcgaatgtcacatgttccaaatcaagccactggcatgcattcatctccttccaccttctctccttccccatcttggttaatggcaagtctattcttccaactactcagaacaaaaatttgaactcatcttgactcttctcttcctctcacattagtcattaattcatcagcaaatcctataggttcttccttaaagtatatccacaagctgacccctgtcaccaccgatgccacttagtgcaagccaagaacctcttggttggtctccctgctcctgctttttgccccccactgattagtctcaacccagcagccagaatgatccagttaaaacccaagtcagattgtgtctctcctctaagggctcccctctcactcagaggaaaagccaaagttccttcaatgcaaccagggggtgtcctgcatggtcctcctgccccccgcccccttgcctctcttattccacttcccatcaggctccaccctgctctctttgcttcagccatgccggctgttcctcagacatgccagcatactcttgccttggaaccttcacatttatcattctgtctgccccgaacactcaacctcaaatagctgtgcagccctctcctttacacaaatggtaactcttccatgaaacctttctccaccactcaatgtccatttccaagcccagcccatgctccccagccccatccctgctctgcttttttgccttcatcctcatcactatctgacccagtggatagttttaattgtatctgtcactagaatgcaagctccatgagacacacatttttgtctgtgttattcattgctctacttccagttcccagaacaattttggcacatagcatgtgttcattaattatgtgttggttaaatgaaggaagctttatgagggaaagagcatgccactcctcttccagcgtcccccttggtggccagggcagagcaggcattcagctgctcttgtgggagaagaagggacttgcaagatcatctcccttagctccctcattttcaggaggccagggacagtggtccccaggaagggaaggagagtccaacctagtttgcctgatcccccatgggaggctgaggttgcaaacagacagctgcagctccttgcagctatgccacacacacagcctttctgaatcagagggtattagtctttccttctgaactcttgggatattcctgttttgatttggctctagcagtgaccacaccgagttgtgcaaagcctgggaacagtgagggcattaggaccaggagtgacgcgcacgcttggctctgggttgtgtctggcagagggctctcggctgagtggagctatgtgtgaaaggaaaccaggcactgcctgccggctttacatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtaagtaaggcccttgttttcccttccctgatcccagggcatgatcgggtggtagcaaactcgggaatgcaaactttccgtagcctgcctctcctgacttagagcaagtgcttttcaagatgcagtacctgggccagcagcgtcagcagcccctgggcactggtgggttctcagaaatgcagattctcagaccccatcccagacctgccaaacaagaaactctgggtggggtccagtggtctgtatgaacaagcccttcaggtgagaatcattgtcctagaaagcagaaagtgaggactcttgcttgttcattctcttctccgtcctgggttctagttcttctgtctttaggtcaaatggctttatttctataacacagaagggaggttagagcagacatttgccagttctaacactctgactccactacattttgattttagggttattgttagtgtttgcttttagtttggatcaaaataacaattgcagtttacatttagggggctcttcccatgcgtctggatttactttacaagcttttaatgtattaactcataaagtcctggaaagtcctcacagctctgcaagatgggtgctagtagtatcatcatgcttattctataggtatgaaaacaaggtgaagttgctttcccagtcacgctgctagtaggtaacaaagtcaggatttgaatgcaggcatgtgagctccagtctgcctgacccaccactccatgccacctgccttgggccactagactaaggaaacaggtccagtgcctgagagccagaatactgtgctgactgcaatttaccctgccagggcagccccagccccaggaggtaagctgagaagtgtaggtgatgggcagagctgtgcccagggagatgctggcccatcctccacaccccctgctcccttactgtcaccatggctgaccactgaggagggagccttggttaccagcatccagggagcaaggcagcttgttagttttagtttggtgatttaggtcccttttcctataggccattgctcctcccagagcctggagagtttcctggaaagcaaacatttgtgcagggcagcagttggaagcagggccacacactcttcggatccctgatctagttcccctcagcctggctgctcagccactcacactcgagggtgtgcaattgcagggtcagcagccgggagtgaacatctccttaaattgtgtgccccgggtgcctcactcaccgcaccctacttccatttcaaacccgctacactgttttcaagccttacctttaaaagctattttcaggaaattcccaccccattctagttttgtgccctccttgcaccctggagttttaactcacagcacttacaaaactaaagccaaatgattattgatgtatttatcagtcgaatgcctgctttccctgctatgctgtgagccccttagaaggtcaggactgagtttgtattgtacatcccaaagcccaacatgcagtaaagaagtgattgctgaatgaacaaacatagttttcaaattttttgacactatttttcactggcctggagcaagagtgagcatcctctttttgccgataagaaataatattgcctgaaacgagagggtctgtggctaccaaagtggtctgtgtgtgtgactgtgtgtttgcatagtgcaaatgtgtggtgaatatgcatatttgtgggtcatggtatatgtatgttcgtgcatgtgtgttgtatatattctctgtgttgtgtgtgcattgcattatgtgtattaaatggatgtcgtgcatgtatgtgtagtacatgcaggtactgcgttatgtggtgcctatatgcttggtgcatgttactttgtgtatgtgatatgatatgcacagctatgcattgtgcaatgtgtcatcttgtgtgcatgtgtgttaatgtgcatgtattatgtgcatggttcatatatgtattgtgtattggggtgatgccacatgcattgttcatctgggtgtgtgttgcagtttgctatttgttttgcatatgttcacgtggtgcatgtgtgcacaggtattgtgttgtaactgtgtttcttgtgtatgatgtgcttctgtggtgcattgtgctataaatgcattgtgtgaatgggatatgcatatatgtacaagtgtgttgtgtttattatgcatgtggtataaagtgcatggatatgttgtatgtggcacaagtgcaggtaaattttgtggtgtgtgtgctgtgcacgtatttgtgtgtgctgtgtgtgtagtgtgcatgggtgtaatacgtgtgtattgcgtatcttgtgcatgtggtgtgatgtgcacatgtactgtgcatgtactgtgcctgtgtgtgctgtagtgtttgttttacatgttttgtggtacatgtgtgcgtatgtattctttgtgtgttgcatgtatgttatacatgtgaggtgtgagtgatacatgtgtatatgtgcaggcatgttgtgtatgttatgcatgtagtgtgatgttcatgagtgtgtgatgtgcactgtgagttgcgtggtgcaagtgtgggtacattttgtgctgtgtgtgtttgatgtgcacgtgtgcgtttatgtgtgtgtgcaacacttcagtggttgcttcttccagccagagtaaccaactcgtcttgacttgcctgagacttcccagattttagcactgaaggtcccaggcagtcgggaggaaactcctcaacccctgcgaagggagacgattggattctccaatccccagcttgccagggttctcacggaacggccgccagctttgtgcggaggtgctcagcgccctctgctggccccggctggtgcgtgcggcctgcgcagcccaggccttggctgcagactcccctctccagtctgcggttcaagctctggcgccttcccttaactggattcctcgcctgcatgcacaagagagtccctgcaaagcaaggcaaacgatctccaccctccccccagggtgacaggactcttcggctcctacccctttaaatctgggccacaatacaacacagaagagaaacaggcatatattaagtgcctgcagtatgcgggccctgcaccgctgctttcccaccaggaccagcagagcgctaggacatcaggagcctgtgcctcgggctgtagcgcaccccgtgctatcgccagccacacatccccttgcaattccatccttgactcctaagccagacaagcccctctggcccagttcctacacccaaatgcccaaactagctctgcctgttgtcctttcccccctgcccaggccacaggcctttttctgagtacctttagagtcatttctggaggtcagtttgaataggtggcatttgaggaaaattaccaatgatgcaagagcaaaaaagaaaaatatcagtggaaaagaggtcaaaagacagtctctgaaaagagaggcaaaattacagtgaacatttattgagcacttactatgtgctagaggctctgctaagtggtttttgttttcaactcttcatagaaaacctctaaggtaggtttcatttcatggatgaggaaactgaggcacagaaagatggagggactggtgccaggttatctgaccaggtgagtctgacaccaaagtcatactcttaaccaccacactacactttgccagtctgccactctccagaccagagattgggcaagtcacatgggctggaagtgttttcatcttaaaatggggagaactcacacgggtccatggggagacagttgcggaaatgcttatcacagcatccttgatggtgctgaggagctggaagccaccaggatgtcttgtcacagggcaggaggagctgggtgcaccctatgagatactcagcctgagttagaagcaacagactctgggtacattcaacaatgaagggagaccctaaaaatcccctgctgagtgaaaaagtaaggcacagaaagcggcctacagcactgtatcattaggggaaatgtaaatccatgcaaactaaccaatccattctttacaggaacagaacaaactcaatgaaatggttgtgctgtgggaaagggagggtcctcggggcagaggtggggataaaactgaatgaatactgaggcaaaatagagaagagcccatgatggaaccgcaaacaggaacgggattaactcagcccttcaaagctgctgtcaaagaaggggcgggaggaacaagcccggcccatttagcctcctgtagcacggatggttttcaaagttcttccaggccccagctctcctttgatcatcctggtatccagtgcaggggcaatgggttcctaggatcaaagaggctgctgtgtgagccagtgctttgtaatctacatctacggctgaacttgagcgtgcatccgaacaactagatggcttgttaaaaatacagattcctggcctccattcctccagtttctgattcagtgggtgtgaagtggggctcaacatttgcatttctgcaaactcctggtactgctgctgctgctgctcccaatccagagacactttgagaacctctgctctaaggcacactctttatgccgaacagactggccagagcagtgctcctcaaactttaaggtgcatgcgaatcttctaggcatcctgttaaaatgcagtcaaattcagcaggtcaggagggcagcctcagatgctccatttctatcaaaggcactccaaggtggcaccagcactgttggcccacagagcacatttttcaacagtgaggagttacaccacgacttcccaaaagtatgtgcacacccaacccccctatattgcttgttaaaaagacgtagatgttcagaccccctcactggcaatgctccagagttctgagttggagcccagtaatcagaatttttttaagctgatgctagatagtctggggaactactggtagagaaagcgagtggagagctggtagagtttgggaagtttccacgtaggaagcaatactagagtcagaaaatagaaaagagagcagagaggaacaggctccctcatggccccggcagtttgtccctaaacataaatgtcaactcagcggtagctggctgtgtgctacctgcttttaacttgcctttatggttcagcctgtgtttccctggtttatgtacccatagctgtgattaaacagttgtggacctgtggttgaatcctggtaccacctgttactgtgtgaccttgtacaagtcactcaacctctctgagcctcagttcctcaactgtaaaatgggataataataacacccttgcataaggttgtagagaaaatgagacacaacgtgtgatgattttccttgtgtattaagtccaaacagaagttgcccttatcatattcttgagtaaatggcctaggagtaagttggagtgatggagaaaaatggagctgtggatatcatattgctgtcctttttctgactgaaaagttattttctggccctggaggctgctaaatcatcataaatgtgcaggtacattggaattatctggaaagtcttaaaaactattcatactcatgctccacttccaaggatttctatttagttggtctggggtgaggcctgggcaccaagagcttaaaactccccaggtggttctatcgtgaagccaggctgcaaggccccaggtggtcaatggctcttcacagctggtggggagagctgggagggatatcttctgctttgttccccacttcctgccccagaggccataatgggcaaggggtcagagggaagggcaggggcgggagagtcgccttggctgcagctttgttgtcaagtagaagatggtgttgcaatccacgcggggtccactcagttccctgtgaagactctgtcctgccaggccgtgattcaccccaagatgactccccacaccccttgttggctgtgatagcctggcctgcaaaagaggaaggaggcagctgacagggcatcagtaaatccaagagagcagacatgcccttcgggatgagggacaagaacaggaacaagctgggcttgagacctggggctggaacttagctcaattccccccacaagagagggaagacaacccagtatgggcagtgtgagtggtgcttatggggcctggctgtccaagtcgtgaagggatgccacaaacaccaaccttccagccctcgagtccacagtggccgcagcagaggcagtacctcctctggacctccactctggatccatcaccccgcagtggggttgcagcgtagacagagctgactatatagcgcccttttttgggtcaaatgcattcatggtaacaagtgtggtagggtcttaccctgcacttcaggacaaacccagctggccttgggggttagattagatgtggttaatctgcaccttgtcctggggtgggaggaattgatgttatttactccagtgccactcacagtgtggtcctcagacctgcagcctcagaaatgcagacccttcagaccccacttaaacctactagatgaaatctctactttaacaggatccctaggtgatttccattcatgttaaagtttgagagccattatgaggccagtggttcacagcccccactcacattagaaccaatgagtcgtcatgtcaaggctccaaagcagaccaagtaaatgtgattcacaggaactcactctctaagtgattctaatgtgtaaccaggctgaggaccactgcttaggccactttaggtgactaagaacagagatgctcaagtcacttaaggtgatggagttactgcaagtttacacaggaagtaagtaaggaacagggaactgtccagacaaggttgaaggaggtggacaggagggagacccacgatccacagttcctttggggacttggccttcctgacatcctgcagcagtaggggccctagaacctggccaagtattctgtacatctgtcagctcacctcctattgtcttgtcactaacaaccactgccctctactctaactgtggtccaggaaccaacagcatcagcattacctgggagctcaccagaaatgcagaatctcaggccccaccccagacctacttgacctaagtctacatttaatgaggtcccggatggttcaagggcatatggacaccggagaggcactgagctacgtcttggcttctaccaccccgtctttgggttactgtctgctctatgacctgctatcaactgctcactttttgcatgtctaaagctcacacttcttgagatggaggatctggcaggtttctctggccgctagcctggggaggctgtccctgttaggtggaactatggctccaagatgcttcataggcctccggtcagtgttcagaccagtgactcccagtgtgtgcctgtctctggttcagaggtagatgccaggatcagagcaagccaaggatcccctgaacccctccagaagtgagctgtgagagtttggagaacctgcacaaagagaaggggatggcatgtaccttgtgacgtctgtccactgatggagaatgacaggctggcagaatcagcctccactgcagactccagccctttcctcccatctctcttgtctgcaagcttcttcatccattcttctaaggcctcagctccaggctgtgtcccagccctagcagcctcaggcctggcctagaagttggtatggtgttcccaagataagtgccaccaattacaggcaagctaggattttcttgcaatggaggaacttggctctgtgggattactcccctgttaatcttgacaaccaacttacacacttcctgagaacaagttcagtgtctttcttccttcagtgaacaaatagctattgaacaactatcagaagtaagaaggtaagcaatacccagccccaaccccaagaagcttggggtgcactgggggatgcagacaagcaaacaggctggtacatcagtgggatcagggctgagatagagaagcctatccgagtggggcgcctccactgatttgataggaactgggagtcagtatccccaaaacagctttaggaaacctggcagaaacctttctactctggccaggcaaggggagggagggaagagcgtcagtactacagccaggccatctggtgcaatgctgtgactcattctcttcagagccatcatccaaatgcatttttccaagttcacaggggatcctggagctgcaggaaaagagggtgtgcatctgtatgtaaacacaagacaccagactcctctgatcttggagtgtgaagatataaagctagcctgcagaacagctctcttaggctaagattatccctttcaatccaggacacacccctgggctggagaaaggtatcaacatccctgtgttggctaattagggattaagcccaggttgatttgagtccaaagcccttggttgttcctgtcccgctgctcccactcaaaggatgaacaaaggaggtcaggggtggggttttggacacttgagtgacacatacaaaccgagatagtaaaatattcaccggatatttcgttgaagcagagaagttagcctcattatttaacaataaaaacatacatttcttcctggatcctctgcataagtccctagtcacttggggccttgctttatgatgttcaagagcctttgccatgctctgcctcattggttggctcagcaatgctatgaatgtctttccttcagttcctggtacatgccagccctttcccacctctgggccttagcagaggctgtgacacctgccaggcatgtcattcattccccacctgcactctctctctgggctgtgtcctacccacccttcaggtcttggctttgatttcacgtccctacatccagaacgtctcactacagctgctgaataatgatttggttatgtttaataggacataaactccatgctattaggggctatcttagtttaggtttcccctaaagaagatcctgaaagaaggcttcattttgccggttatcccaagaagcacgggtaggggctcaggaaagcggagcagagatgcctgagagaggcatgtgttcaaggcagctacctctgtgggcagctggagctcagcccttggagacagtgtagaacatgcatgcatctcagcgcttcctaccctctgcccttaggggtgagggtgctgggtgtttaataaaccaactcttttcaatcactggctgagcacagctcactggggtggggtaggggttaattttccagctcttcagggatgctctgactggggaaatcacactggtcagccagagaaagccctagggccattagaagttgggccgtcctgtatcataatgagatggcccaagaggatatgggcaggggcaccacagattgtggtcaggcatcatgtctatttcattcatctttcagtcctaacacataataggctgtcaataaatatctgttaaatgacttgatagagagatggaaggtgaagattaaagagaaaatcagaatgaagataggcagtcctgtctagagcctcctcaatgaataaatatcctgtttccttactctgagcttcctggcagccacactgaaaaataaaaaaagacgatattcttatttgtattcttcatgaggaggaagcacactgttgctcagatgaaggaaagtattttgtggcacttatatctgcaaggacttttcttccaaagcatcaaagtggagataacaagtgacagggggacaacatcctcaataagttccctcggtaatggagagcaggtttcctaaaagtgattcttgcattgttccctgatgaaagctgagagcacgatgacaagcacgactccctgtaagcacatttgtaaggcagccaagactgaggggtcaagtaagttgccttttgaagaccttaaggaatcagcgtagacagtgcagaatgtgtggaggaactgatggatcgcatgtttttcaaataaccttccatcattgtccctttatgactctgaatccagaacattctgctcgcactgtagtccaagatggtgatagacagacagatagatagatagatagatagatagatagatagatagatagatgatagattatagcaatatactatcagctatttgccgtgtaactttaaacaggtcatttaagctctctgggctctagtttcctcatcttaaaaatgggaaagtgtgtccatgatctagtgctgtataacgcaccttatcaaaacttagtagattttaaaaaatagatatttttaaaactttggtgcttcaaaagatgtcatcaagaaagtgaaaagacaatccaagagtagaagaaaatgtttgtaagtcctatattgcataagagatttgtatccaaaatacaaaaagaacccttacaacccaacaattaaacaacaaaacactccattttaaaatgggcaaaggatttgaatagacatttcttcaaagaagacataaaaatggtcaatagcacacgaaaagatgttcaaatcattagtcagtaggaaaatacaaatcaaaaccacaatgagatgacattttacccccactaggatggctgaagtaaaagacagtgcaagtgctgacaaggatgtggagaaattggaaccctcacacattgctggtgggattgtaaaatggtgcaactgctttggaaaacagtttggcagttccccaacatgttaaacatggagctatcatatggccagtaataccagtcctaggtatatactcaagaaaattaaaaacatgttcacatgaaaacttatacatgaatattcatagtggcattagtcataatataagtcaaaataggagcaatccaaatgtccatcagctgatgaatggacaaacaaaatgtggtatattcaaacaatgaaatattaggcagtaaaaagaaatgaagtactgatatagactacaacatgattaagcttgaaaacattatgataagtgaaagaaatcagtcacaaaaggccacgttatgtcatttcattcatatgaagtgtccaaagtaggcaagtctgtaaagacagaaagtaggttagtggttgccacgggctgtggtagttgtgggagcagtgggaagtgactgccaatgggtagtaggtttttgggggtggggtgttgaaaacgttctcaaattagacagtggtgatggctgcacacctttatacttgaatccatggaattgtacactttataaaggtggacattatggtatgtgaattatatctcaataaaaatattattaaaacattagtgatttcaggccgggcgtggtggctcactcctgtaatcccagcactttgggaggccgaggcgggtggatcatgaggtcaggagttcaagaccagcctgaccaacatggtgaaaccccgtctctacaaaaaatacaaaaattagcgaggcatggtggtgcatgcctgtaatcccagctactcaggaggctgaggtgggagaatcgcctgaacctgggaggtggaggttgcagtgagctaagataatgccactgcactccagcctgggtgacagaacaagactccatctcaaaaaaaaaattagtgatttcaaacaataaccatttctatgttatggttctataatttggaccggactcagccaggcagttcttctgctgatctcccctgggttcacccctgtggctgccatcagagggcggctgactgcactgaatattaagatggcctcactctcagacctggcagctgatgctggtcctcagctggggcactttagtttttcttcaagcagactgtaatcctctattaggctacgttggtttcattacatggcatctcatgacagcaagtggaaggccttgaggcttaatcttgggaattctcgaatgtcacttctagtacattctattggtctaaggaaggcacaaggccagccagacttaggggctgaagaaatagattccatttcttgatgcaaggagtggctgactcacattataaagaaacacgatgaacagatatgttgtgaccatctttgcacacatgaaaattcctatttcaaagggcatttgggaggaataaatgtaataattcttgtaataattcatgctgctaaagcacagcacctggtacataggactcctcatgaagtggtggctatgataaatattaataagacacctgcatcacaggtgctaccctattcctccattctccctcagtgaaaacaaatcatagactcaaaggtggaaggatctttagatattacacagtgaatccctcagtgtcagatgtgggaacaagggccagaggagagaagggagagacttgtccaaggccccttatctccattccctcaagggggattcagaggtctgagcctgatggaaggtcgtcgtccagggcatgtggcacatctagcacatctagcctcacgctcttccccccagaccattatcctggctccggctgtatatacttgtaagggggcgtctcagaggaaaagaatcacagaaggcaaagtgttgcctgtgggtgaaggaagaggaatcttccccagtggtggaagtgagaagttacaggaactcagttggcacaaaatggcagccataggtcgtgtcccatcacagacatgtttgtttggccatgcagttttatttaaaaatgttggattagtggtcaacatttaaaaattaagatatttcccagaaacagttcaggtttctggctttttctgaaaatcaggaagatgtggcaaaactggactaaatttcctcccagtgacatcagctgttccttttaggtgggccatgtggtctcgggctcactgaagcacccacagggcaagagtcacatctccctggctggtgtttgagcttatgctcccttcaaacctgaacaaaggggttggagcactaggaggggatggtgtagatgcagttcaggacctttcaaagatctttgttggctggaccttagccagcttcctaggtttccagtggcttctctgaattgctgctcaaaccctcctcctagttctggtctacccacccctcattccttagtgcctgaagctctgtaaggttgggtgggagcgggggaggaagagtggatagattgcaaagcagatgacaggtccttagcaccatttccctctctgtcctcacttccacctccctccttgtgtcctctctctccaaggtcctcatgatgacatgaggagcccagggttcccaaacatgggcgagtagggccataccatctggaccatttcttattgtctcctcagcatctcccaaaacttacacactcacatcagctaaggagttggatgctttctattacaagctttatccttctgaagggaagtcatcctgcattttaacaacaacaacaaaaaaaggaagccaccaaagccactggatgagcaagaagattggagagctttgctcccggtggcagcctgaatcacaggaaacattttgctgttaggccagggttctagggagattaggtccaacaggggatctagctgaactccaatcacccacctggcctcctttgcctgtaatccatgaggtgaacagcaccaccatgttgcataactccaagagacaccagtgcatggtgatctctgagcatggcacccactggtgttgggcaatgcaccagccctagtggttgagatgaggagtaaatgagataatgcatgagaatatcctacaaatatcagtgattgttattcccagaataccagcccagttcctctgctatgttgaaggacatcctcagagacatgttcagacaataccagaagccagtcagcacatttttacctgaaaaatagtaacagcttccagttattgaaagcctgctgtggacaaagcacacaacattttacatagccctttaaagtaaccctacttgttatcctcattttatagatgaagaaattgaagctagaaagatatccaggcacatgagaggtttgcaagaatcaacaatagctagctagcattttggggctcttactatgcataagtacttcaaatgtattagctcatttggtccttccaacaacctcattttactgatgagcaacatgagtttaagtaaattgtatgttcaagatggattaatggagtcaaaaagattgtgagaaatgagaattagtgactgaagtataactgagtctgttggtctggagactgttgaaagcaaggatagttctcagagagcttatggtacttgcccaggtcacataaggacagactgggatttgaacccaatgccaaaacttcgccttttatccacttgataaaacatcagctgaactaacacatttttgagcaagtttatcaaggtgaatggaattgcagtttggccgctttcagggactctatttgcttgccacaccctcctacttggttctgtgctgccacctggaacaatgagagaggattcatcccatttgcccatacctgcatgactgtgctgcccataggctgatgaagcccatcctgggatgatgaccatggactgccataagcctgtacatgtagttggtatccctcccttccactgttgtctgggagctaaacagtctgcaccatcctcaggctccccctccagcccactagaaacaaaacaatccctggctaggccgggcatggtggctgacgcctgtaatcccagcactttgggaggccgagatgggaggatcacgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgagcccgggaggcggagcttgcagtgagccaagatcgcgccactgcactccagcctgggggacagagcgagactccgtatcaaaaaaaaaaaaaaaaaaaagaaacaaaagaatccctggcttttcttaaaagcatctaacaggccctgagacacaagactttgtcaaatttgggttataatatttagttccacactccaagccatgttgtgggtgctgggccttctcacaaacctcaggctgggtccgctcagctgctgctggtcctccactgaaacaccagattatttccacggtgattttcagctctggtctccaggcagttctgcagttgcagaacaaaccacagctgtcggtttacgtcttgaaggctgcgtgaacttctttccctgagagaggagaaggattctttctgagctgatgccaggagacctgcctccacagcttggcggggcatcccccatagccttgtaatggctttcaagaacccatttggcctttcacatctcttagcagcctgtttagtttatcccactcacactccctgcccatccattggttcaccatcttctctctcactatgaggagagaagttacatctgttcataaaaccccaaaattcctggagcaaggggagtctatgaaattctctttgaaatgcttgctgtccttatttttctgcctccttcttcctcctgctgcgggaaggagcccccaaagaatcaagaacacacactttcaaggctggaagagcctgagaggtacctcttgtagtaatgggacatctgttaataatggcagcaaacgcatggtgctcactctgtgccacccactgttcttggtgctttataaagatcatttcatctccacaacagcaaatcccaaaaagtgggccctacggctacctttctgaggaaaccaaggcacccagaagctaagcaactttcccagggtcatctccgcagctaggaagtggtggagcctcagtgtccacaacctgagttaccaggtgagactgccacccggcagagaatgttctgtgaaatcaaagaaaggaacttgagtgccctggtcaccatttaactagcagagatggaagctctcacatctccttactttgagtaatatgcaaggagtgtgatcttaaagagctagagtttaaatacaaatttctttcattgaaggaggccctgctccatgccaggcactgtgccaagccctttatcaaacttatttctcccaaaagctctgaagtggacactgttgggaaacccaaacttgaaagtagttcagtggatgtctcatgctatactgtagaatagttgtttaaagatagctataatttgcaaagatgatcataaatataacattcatactaattacattgtgtctttttggaaaatggctataaaacagtcactgtctattgggtgcctattattattctttgattctctcaatgggcctaaagggtaattatggttacccttaccttccaaatgaggaaactgatacctataaatattgagtgaattacccaaggaaacttaggaagcaacggagtgaacattcaaatctaaatatgtctgattctgaagtctaagttcttttgaccatcttactacaaggatacatacaccacacgcacacacacgtgcacatgtgtgtgcataacacacacttgtgttgtttccaattctcatagtctatgaattgagacagagaaaggagccaggcatggctggcaggcatagccgtgctctcttcttggagcagacaggactgactttggtaaactattaaactgtccccacaggaattccaaacccagggctctctgtcccaaactcctttcctatctcagttggcaaatagccagcctcccggcaacaagcccaattaatagtttagggttttttttttcatacccactaaattcactgaggcaaaatttcttttcacagccaccagtccctgtctaggacccctgggtttacccaaatgcatggccacaaaagaagtggagaggatatgaggaaattttgcacctgtttgtgagcagtctagagcaagtctgagggcagagcagaaattctcagccccaccaggggagaaggggagagaatgaagggggtgaaagacctcagcaaagactatgcatgtgctggggacgcagtcatctccctaaaaccttacagggaagctggttccattttggacatgttatttgagcagccctgaactcagactataaaagttcatataaagttcattattttatttgttttaagaatggttctcagaatgctgccatgcatttagggacttcttgctaaagtccataggaatttatctttcaaataagtgttagatgggtgttaaattttctctttaaaactaatatgatatttgagttaacagtattgaaccatgtcggattcctggttttgctcattgtggatgattacgtgagatattttcatgatggggagctaggtaaagggaacataggaactctcagtttcttgtcagtcttaaacgatttcaaaataaaaagtggtaaagtgggaattgaaagaaaaaattactagaaagagtgttgctttccccaaaaaccttgcatgtaacttctctaatggtgataattctgttgcagaataaacattttactttggctaccagggatctcagagtcaaatttaaattcattctagaaatacctaggcccttataacctatatatttatgttctttctccaaatgctgactttctaaatttacttatattcctcagctcctgacttttcttccttatttttattttaccatcattttaagtatttgtattgtgtgtatttttttgtgagtggcttcaaatcatttatggaaataaatagcttgtaaatttataaaccaacaaaataattagctcctttatgagatgtttatgtgtttttaaaaattatttaggaattctgcttaccattacctagactcaattctccctctctacacaggattttgccctgagagtcacacacaggtttcctgtgcattgagagttttctgcctttcttaggactggtaccaagctagggagcagcaagagttggcacatcttagaaggtgtttccctcagacagggccagcctcagcctggttgtcactctgcccgcagttccacctcacagattcctttaggtgtccgaagtttggggtccttgagatggctcctattcaaatgtccctctgaggaggaacatagtttgagcagcagctgcaactcagaaagaggctcttcagaaacacacgttaagaaagtgccttttgtaagcaagtgtgagctatatactgctccatgtatcaggttgttataattcactccaccctggacccactgattctcaacagacccaaagcaaggcaaacaccaagcaccctgttcacagacagcccctcagcagagggaaatgcaaacacccctgctatccagccataagccagcaaagtggaaagggtgtgagagttttgaaggtagaacattcagcgctgccacttgccagcaatgtgagctttgatgtcttcccttccctcgaagcctccgtttccttatctgtaaaatgggagtaagatagcccaacccacggattaattatcagatgaatgtgcagtgatatattaaaggccttgcacggtgtctggcatgttgttggcactcacagacactccatccttgttttttcttccataaaaataataagagcttaaatgtcttctcttttagaagtgtctgttcatgtcctttgccctctttttaatggggctgtttgtcttttttcttgtaaatttgcataagttccttgtagattctggatattagacctttgtcagatggatagattgcaaaaattttctccaattttgtaggttgtctgttcactctgatatttcttttgctgtgcagaagtgcacatgtatgtttgttgcagcactattcatagtagtgaagtcacggaatcaacccaaatgcccatcaatgatagactagataaagaaaatgtggtacatatgtaccatggagtactacgcagccataaaaaggaatgagatcctgtcctttccagggacatggatggagctggaaaacattatcctcagcaaatgaacacaggaacagaaaaccaaacaccgcatgttctcacttataagtgggagctgaacagtgagaacacatggacacagggaggggagcaacacacactggggcctgttgtgggggcatggggagggagagcatcaggataaataactaatgcatgtggggctgaatacctaggtgatgggttgatggtggcagcaaaccactatggcacatgtttacctatgtagcaaacctgcacgtcctgcacatgtatcctggaacttaaaataaaattttaaaaaatagtaagtgctaacatttaaaaattgtgtgccaggtgctatgctaggttgtaggaacataaaaataaagaaaatagtgtccctgaccttgaatggatgacagagattactggacacttaactacacgcatcatcctatccaagcctcaccacagcctcggggagtcctgatcttcccagaaggccaggaggggtgtccctaggtcatttagttgtgccagaaatgtaggcctcaggcccaagccaaagactagagcagaggttctcaaagtgtggtccacagaaaacagcagcatcggcatcacctgggagcttgttagaaatgcaaattcttcagccccactccatctccagaaactctgggggtgggccctgcagtcagtattttaaaaatcccaccaggtgattctgatgcatgctcaagtgtgagcgctgtgagggtgataatattgtcattcattctcattttacagatgaggacagtcatttgctgaggatgacggcaacgcttctcaattgcaatgagagggactttggattaaatgataaaggagctcttgagatctgagaattgggagatagtagacagcaccactatgaggcgtaacaggttctttttatatgggaattttaagagatcccataggacagccatataatgggggcagctccagccagagcaaaggaagcgagttagagggtgtggagtgtttcttgtggccttctcttccccatggctctctggctctcttccctgcaggtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggtagccacggctttcctccaggctcgtctgggtgagccttaccccctggcgggtggagttctcaagcaaaagattgaagtttggaactattttaggcaagattccccaactacagacctccagatgaggattaatgggcaagtaacttatgaatgaagagccactggggaaaccagtaaggcagtgggggctgcaagacagagaaggagaaagagccctgcaggggaaacagccctggggagggtcttgaggggtgtcgcctcagcctgatcccgtggggatctctctcccaggtgccacccagtccaacaatcctctctccaagacactgaagaatcacatagggcggccctgttgtgagtgctcactgcctcctagaccctggtgcagcactttacacatacgcacatatgtgtatcggtccttcactcatcatggcttagacagacccactcactttccagaggaggaaactggggcccagagaagacagcagactggagcggagtcagccaaaagcagcagagtcaggcccagagcccagacttgcagaacctgcctgtgtgcttcctctcacaggaacctggctactagggacagccctaaaagaagatggagacagagaagcccccacttgactcgtaggtcagtggctctcacgcttgagcatgcatcggaatcacctggtgcgatttttaaaatactactgcagggcccacccccagagtttctggtgatggagtggggccgaagaatttgcatttctaacaagctcccaggtgatgctgatgctgctgttttctgtggaccacactctgagaacctctgctctagtctttggcttgggcgtgaggcctacatttctggcacaactaaatgacctagggacacccctcctggccttctgggaagatcagaacgctctgagggaagccgagcattcacgtttttctaaggggaataatggagaagggctagggtagccaggtgcctctgttagttctttctacggtcctcactccagggatgggcctagcctggccatagcagtgagtcagattagccagaggctctgggaacacctggggttcctgggtgcagctggctgcatattaggcaggactaatgaacaggtgcaggacagggctgggttggcgggtaaagtgcccagagactctccaaaccctcaagtggggcggggtccgcccaagagcacacctgtggtgaggcccccaccatctgatgagctgtgttacgtctgtgcccctcgggagtacggaaagtggaggagctgggccccagagaaatgggctaccccagagctggcagccccaccagaggggatctggatcccctgccaagcaattaagctgccccctcctggccaactccccttctgcccctcaccactgggttggctctccatccagtggccccatatttcctgttgacattggggtgcaaggccttttccacaaccaagggcagcactggttctatttctgcaggtccctctcctctgtgtgcttgccaagacccagatcccagacaagcaccaccctgcacactgtttttatttaatcctcttggccacccagagaggcagggcttatcaaccctactctacctgtgaggaaaactgagacagaaaaagatgctgcgggttgccctgagccaccttgatgggcttccaagccgatggtcatgacagcatagtgtagtgtgatagaatcagctagatgggtttcagggtattcgtctggggtggtgatgcccacaccaaatcattaaatcagaaaatgcttgcgatgaccagcccatgatgaccctttacaagtggaagtcagtattactgctgttttctggagggaaggagttgaggatcataccagctttttccgagcactataccactcagacatgggtgctcttacccacttcaaaaccctctgagaatgccaaacaaccatcgcagtctggaagttcttccttatctattccgaagctctcttgctagaagtctgtcctaaataatactaacaagggttagaggtatagctgaagagaccagcagtcagcccaaggagggcttcataaattaatgtttggtgggaatatcagtgaaggactatatttggctgcacagaacagaaacctgctgcagtgacttaaccaatgaatagagatttatttttccttatagtatagaaagctcacagggtggcaatgcagtattggtgtgacagctccacaatgccattggacacccaccttcatctgctttccacttcaacatgcttagagagtagttttggcctcataatcacaacagggctgctctacctctggacatcacatacatatttcaaatagggaaaaggcgaagaagagataggcagaggccagtccggtttgtgctcttcggaaaaaaaaaattagtaaaataatagttttcccagaatcctttcattcattttatttctaccagagctgctgccagcagtgacaggaagtctcgagagatacgtgtttttagctgtcccgagaaacatcaaagttctgtcagtacagtggaaggggagaatgaatggtgaggaagatgttacatttagcaatgttaaagccaatgaagtcactgaggggctgcttctcagatatgcaagtccagaaatgttaatagcttgactaacagagattcctctctagggagtggaccagggctgacagtcttaccagaaaaataattataaagtaacacatcaacgaagcattttaccagtgagaattgcaacagcccagtgactgggactcctttcctctactgctcaggacattgttcaccctgcagaaaatccatggtgcttagaagacagattcccagggaaggagtgtatgaagtctgctgggggctctcgggtggggctgccttaaccttctccagcctccccagagatccagctaccaaagcagccaggctacttgtatccacagttaaggccacctctgggctggggaactgggggggaaattcttgctttttggctcagttctgttcaatgcacatgtactgagtgcctactgtgggccaggccctgcactaagggttagagcagaagagatgcattaggtacaacccctgtccttggggagatcttagtccactggcctggggggactccccatttccaagacttcatggagaccactgcttctctgtgaacacattgttccttccatctccactggcttgttcctcttggtgtgtgtgtacacagacatgcacacacacacacacatgcactcacacacacaatcaagttattcttatcttaaacacaaaacctaacaagcttctctcatcctttccgtcatcttcttaggcctctttttctcccttcccctatagaatcaaccttcctaaccgtctggactcttggtctcagtttttcatcttccgttttctctcccggacccactgtgttgcagactcccctatcaactgcaatgagatctctttgaccagcaccaccaatctcctaccagctgccaaatttaatggagccttttgcctttgacttccttgaccactgtcttaggtcaggtttcctgaaagcagggcctgagatggagattcacgtgcatttgatttttttgagggtgtactctcaggggaaatctgtaggggagtgagtgatacagaagagagagagggaagagctgaacaaatatgtggtttcaggtgaagtccagccatagcctgatcccatgggggactctggagcacaggctgcactgcggggtctgtcttgctttttaccctgcaatggtcagtcattgaccatgactggggctgggggcagcatcctgcatgactgtctggcacctgcagcagagaccgttttaataccccaaggcaagtctccagggaagggttaagatttcagttagcacccacagcagctggggacatgcaaaccaaaccaaaacagttaaggggagctcagggaatctgagtaggacactatattagtctgttctcacactgctataaagaactgcctgagactaggtaatttataaagaaaggaggtttaattgactcacagtttcgcatggctggggaggcctcaggaaacttacaatcatggtggaaggggaagcatgtcttacatggcagcaagtgagagaaagagagagagagaggaggaaaaactatcaaacacttatataatcatcagatctcatgagaactcactatcacgagaacagcatgggggaaactgcccacatgatccaatcacctcccaccaggtccctccctcgccacatagggattatggggattaccactcaagatgagatctgggtggggacaaagagccaaaccatatcagacaccaacagtatctgctacattcttgctgctgcatttggagaatgttagcaagttctcccctttcctggttttctgacaccatccctctaatttttactggagagaatcatggcccaccccaacctaaccaagcatcttacatctcagcaacaaccacactgtagtaatgttttcggttcttaggacccaggtgctcaccacagcttccaaaagagagttgctgacgattgtcttagtcacaatctcatcggttgtggcatttgtcattccactgaccacaaccctgttgattccaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggtaacttattccctgggcttgcaaagcaagacatggaactgggagaaacagtctacagcatcagccactcacagagcaacccacctattaattcctgaatctccattagagagtgatatattcccttcgggttttcagatgtgtaagttttttaagactatagagttagagttggaaaggaggttagaggtcttcatctaccttgctttatagataaagaaaccgaggcctggagaacagcttctatgaggttgcaaatacttaaaattgtattaaattgcatgacgagggtaacaccttaccatagctatcattgcctttggtgaaaatttggcaatttttttttctttttctttttctttttctttttctttttgtgatggcgtctcgctctgtcacccaggctggagtgcagcggggcgatctcggctcactgcaagctgcgcctcccgggttcacgccattctcctgcttcagcctcccgagtagctgggactacaggcgcccgccaccacacccggctaattttttgtatttttagtagagaaggggtttcaccgtgttagccaggatggtctcgatctcctgacttcgtgatccgccctcctcagcctcccaaagtgctgggattacaggcgtgagccaccgcgcctggccgaaaattcgtcaattttaatcaagcttgtaacataacctggggaaaaagtctctgaactacactaggccgtagattactcacccataaaaagaaaacattatgttctctgatcactaaacagcattctttgtttccccagtttatataaggggtccctaattttctacctaaggccagtccttggaaatgtgaagttggagaggactgcattacattaccctgtagacaagcatcttaacatttttcttgatcatttctctgctctccttcccccatctgaccgtcaatctctttctcacttccttgctcaagacaaacagttcctaaacatgtctagtcaaacattaccctcaatctgaatatcctacccaggaaaactgaaacctggtggctggcccaccttggaccacctcaggcataccacttggagctcatgtaggcatgtagcagagtagaaccacaatcaataattgtttgatggtgcccagcaagacaggaccaatgctagaaccaagccttatgacttctacccatgatgaatgtttattatctcacctgaagttagggatgatcaatcaaatataagaaaaaattcctggaccagatcggaatgaatcctggagacataggagttaccatcagccaaatggagatggtttcaaacgttcaaatgacagaaagtaaattgttaatagttcagcattccattttaacaaagaagaacaatcggaactcaagtgagatcaagacagattaatgtttcccagtttcatgagacagattgtctcttgactcacatctcataagaaaagaagacacacataaattcagcactaggacaagaactaggacacaaaaatgcacaagctggccaggcacggtggctcatgcctgtaatcccagcactttgggaggccgaggcagacggatcacctgaggtcaggagttcgagaccagcctggccaacatggtgaaaccccatctctactaaaaatacaaaaattaactgggtgtggtagcgtgcgcctgtaatcccagctactcgggaggctgaggtgggagaatcacttgaacctgggaggcagaggttaaagtgagccaagatcgtgctactgcactccagcctgggcaacagagcaagactccatcccgaaaagaaaagaaaatgcacaagccctccaaagctgccatttttgattctgtttcatgcaaagggccatcttgaaatcagagcgatgtctatcattggagtcagactctgaagttgatcttgcccatttcccatctgattcccattctggtatcacagacaggtggctctcagagggaccatgaagatcatcttgtcttacctcatgatttcgctatcgagaaccctgagttccaggaaagtaaaaaagacccctcagggtcacacagccatttgacaactgggctgttttctatgctgcttttatgcagacatttagaaatgcagtaattaacatcattaaactttatgtatgtgtaaccctcgcagacttctttcatatgccttctttaatgacccccatgagaggcctcaggcaggtattttagcttctgttttatagggggagaaattgaggctcagagaggtgacatgatatgtaagggcagataattcgtagctgagtcagattttctgactctgggtccagtgctgtttttattgtgtacattttctttttaagagttggagaagctggtcagggaggaacattagtcatccctaaccccacaactggttatgagacatgtgttacctgctgctgtgagtccctcgtatctgcttctcacatcggggccccatttcccagagctaggtgaaggtagaaagacgtggcactacctcagtgtcctaggctagaaagaaaatgaggctccctgggaagccctttgtgattaagagacattctagtttcctgtgcccttcccctctcctcttttcctctcctgtctgtctctgcctctctacctctctcacggtctttgtctctctctgtctcttggtcactcattctctctctctctctctctctctcacacacacacacacacacacacacacacacacacacacacacacagtgggcctctgatcctggtgtgttactggcttgccttcctctttgggttccatctcttctgcgtgatgtgaccacattttcatcatctctacacctcattcatggcttcttgtccactgtgttttctctgggccctagtgtccagcttttaggcactggcaggtgaggatctggaagaaaagccacctttctggtatctgagtcccactctctccactccacctggcaacgctctatgagctgtggcagggagagcagcctcattcagtgtgtgctttactcccccagggacgtcgcccacgtgcctcatacaaagccaagctgtggaaggcatttggtgcagctcctcacatggagaggagagggggcccagctgtctccaaggcttgtgtcaggagacattctgtcaccagatgaggacacagtgcccaaaagacagaaaagggtctttaagagctcttataaaaaaaaaaaagtggggtgggagtggtgagtgaacagtgcagtaagccacaaatcagctctttcaaagagccgtagcctcctccacaccctggccaaggaattcagagcctgctgaccagcctttgttccctgtccctgcctagcaggttcccactagccatgtggcaactttatttgaattggtagaaatcccttcctcatgaccattcctcctgactcccattcctcagaaaattggtcataatatactgattttattagaataagacatcttaatgccaactgtcagcaagttgttgaaataaaaatgcaaatttacagtaatgataatattagagatgttctcttgggttgcacagtgcgcaactcctgtaactgttcatagcaaccctacatagagtctccctatgggcaactgattttagggcagccctgggagatgctgattgatggccagtttctacacaaagtaacaatgatgggaatcaagactagctgttgtatccagctctcagctgacttgtgttgactgccagctctcatacccaagccaagcagtggaagccatacccctggaaggatgaaggtttctaaggggaaagggacagtcttgaaaggggctgaaagatgatatcatctcaagaagctgaacaagttatctcttacttgaaaatgggtctggtccctatctgcgagacatccggtccttcaggatcagccaggggtgctatggggagaagcaatgtggggcagggagaagaacacctcccactctgccctttgaagggttaaatgatggaaagcagtgtaagaaccccttgtgcttgtgcatgtgagtcagtgtgtgtgtgtaagcatgtgagagtctgagtgtgggggggagcgagcatgtgcgtgcgtgtgtgtgtgcgcgcgcatgtgcgcgtcaaggagcagcaggaggtcaggatgcctcctgcccccccagagggagcagccttctttggctcaggtgccccaaggaaactctccagcaaccatcgtacttcatacccttcagcatgacacgtcctcgtatctgcccctggaaaagccgatgccagtcctgcggtcacaactgagcagcaagagcactgggaagggagaattcagagccttctgcttctagtataagagactttccacaaacaccaagaatacgcatgaactttcaaaatggcttgtgtatcatggaccttgaggaacatccaggctcacgagaattaacaaggaatgagataaacgagggcttattctttattgtggtaaaaggttatgggaagcttgaaactacagttagctcttgaatatctggacagtaatgtattcgttgatctcacgtatttcagtgaaccagtctttgttggcagcttgactccttctgtttgccttttgaaacataagcacttgatctcctggaacttaggctcaacataggatcaaccttgtacctgcctgagggttaaaactcaattcacaggtgagggactgacgaagtaagcagacacttccagctccttccaagtcaaacgaggtcagctcgctattttgcttgacgtgaattccaagaacaccagacacatcggtaggtacaaaaccacaaagctaaatagaagactgtgggttttttatttgaattaatcaccgtttttgagtcagtagactacagttagtaatttagtcctgctaggcagccactgtggtccatgggaataaagaccaaaatagaaaacactcctcacttcattcactgacattttattctttatctctatccaaaatgtactcagggaagctcatgattaatcactcttgtatacagttaaaatagaggaaaaagaagatttcagaaaggaaaagagggtattgggaatcaggggtaatacagttattagaagtgagttttacatgtgactctgagcttccagaaagacaaaacaaaaagagaaacataatgaattttagaattctcattttctaataaaaagcaacgtactcctttgttaagaagtacacagcacaggctgggtgcagtggctcatacctgtaatctcagcactttgggaggccaaggctggcagatcactttgagctcaggagttcgagactagcctcaacaacatggcgaaatcccatttctacacgcacacacacccccacactagccgggcatggtggctcatgcctgtagtcccagctactcggggagctgaggctgaagaatccttgggcctgggaagtggaggttgcagtgagcgcagattgtgccactgcactccagtctgggcgacagagtgagaccatttaaaaaaaaaaaaaggccgggcgcgatggttcacgcctgtaatccccagcactttgggaggctgaggttgggggatcactaggtcaggagatcgagaccatcctggctaacacggtgaaaacccgtgtatactaaaaatacaaaaattagccgggcgttgtggcgggcacctgtagtcccagctacttgggaggctgaggcaggagaatggcgtgaacctgggaggcggagcttgcagtgaaccgagatcacgccactgccctccagcctggataacaaagcgagactctgtctaaaaaaaaaaaaaaaaaaaaaaaagaaagaaagaaatacacagcatagaggtctaggatgaattgattgcaggaatgcttgaatacaagtccctttcttgtcctcttatgattgctgaaggtggcacaaatttcatgcatttcttcctaattcagccacacagttccctggctcttgattccaaaattccacaaaatgctttgccaatagccaaatttatccatctgcctgattcattacacagtaagtggaggctctggaaggggctctgggtgccctcatttcctccctggtctaggttctcagttttcttaggtcaatacagggtaccccaaaataggggaaacccagagggattatgttccctttgccttccagcagaaacaatgtgaaagaggcaggaaaagcatattaagatccttgctctaaatatagaccccacaactccttacacttatgtcagttacctaaagccatagattaaagcagataatgaaatcatggggccaccctggctctatccaagacaatggaacagagatggaatttgatggtagtgtaaacacaatgtggctagtatctcccctcccaggaatctcacttctcttagagtgatatcttctagccaccctgaagttcaggcctgattcattccatggcacagattgaagacataattaccatgacaggccagggggagaaaatgtgattgagatattggctaggtggatagcagctcctgggacacctgagtgattacctacttagttaaaaagtatatgacccatgtcaatttctcacatcactctgcagtcatatctccaggctgtaaaaaaaaaaaaaaaaaaaaaaaaaaaaaaaaaaaaaaaaaattgggcctaaaattccccaccattaccgggaaatgagcaaataacccaaaatagtcaggactttgattatagataccagatgttcatatatgcatgcattgacagtagggttacttctagggcttggaaatcctgatttctcaagccaatccagttttacactacaaggaggaagaagaactagacctgagagcaggggtccataaactctctgacatcgtgcacaatattttttatatggacatggaagatttcattcaggagtggcccatagttttcccctgaatctcaaagggatcaagcaccccaaaagaagttaagagccacagtcctagagcattgcagctgagaaaggcctttgtgggaagtagttcaacctcccattctacaaatgaggaaactgaggcccagagaggtataacaggtatctcaagattacatagttcattagtagcagagctgagcctaggacccgtctctgtatctctcagtgctgtcaagaaaggtttttgaagaaagaaaagtactggcatgctctttaaagcaatacaccctaattccttatggaaaaacattttctagaactgtgctatataatataaatataacacaagccacatatgtaattaaaatacttctaatagtcacattacaaaataaaaataaacagatgaagttaattttaataatatagttcagtaaacccaatatatccaaaatattaccatttcaacatataatcaatgtaaaaattattaagatttttgcatcattttttccatactaagtattcttaatccagggtgtattttacacttactccacacctgatttggataaacccattttaggtacgggtgtctggtagccaccatactgggcagcccatgtacagactgtttccagccccagcaagtaaatgctttacgtcccttgtttaattccacaattctttccaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggtgagtccccatttcacacctgctttgccattgcctcctcaggatggactctgcagcctgcctgcctggggtctaatcctacctccacagtttcctagtaaattacttaatgtatgccacagtttccttttcagtaaattgagagcaatcatagtatttacctataagggttaccctataagggttgttgtgaagattgaatgaactaatatgtgaaaagcacttagagagtgccaggcacccagatgtaggtgctaccaccattatattgtcatattcataaagttccgacagggtcttccagatagcatcagttaatgccccagtgtgtggcaacctgagatggaatcttggcccagctctctcatcaggtacagtgtgaattcctcaggtctcgtcttagcaaataggaagaattcaaccaggtgaatgctaagaaccataggtctcaaatatatcctattgtatgggtcgcttctcacatgtttggtttttggatgactcttctatttaagtagaagtactagatatcttatgcataacaaatcacctcaaacttggtgtaaaacacagccattttattaagctcatgaattctgtgggatatgaattctgaaaggacacagtggggttggttgtctgcccccatggtttctggggtacataaggatttttaaagtttcccaacactataaagccagtgagaggtgaatccagaatttaaacccagacagccaggcccttgagacgactgcttcactgctatgctatattttaaatacaaggccacagttcattattcacaattgcaaaatccaaaaagctctaaaaaccaaacatttgtttaataattcattaggcagcaggccagatgcagtgactcatgcctgtaatcctagcactttgggaggcagaggcgggctgatcactcgaggccaggagttcgagaccaacctggccatcatggcgaaaccccatctctactaaaattacaaaaaaaaattagctgggcatggtagcacactcctgtagtcccagttacttgggaggctgaggcacaagaatcactggaacccaggaggcagaggttgcaatgagctgagaccacactactgcactctagcctgggtgacagagcaagattctgtctcaaaaacaaaaaacaaaaacaaaatcattaggcagcaaaagctgccctgaactgacatggggtgtctgcattggccttatttatcccacttactgcttactgtgaaaatatgtgtgtttcatcaaagaaatattagtatatttgactaaagagtgccgggcagaccccactaggactgatgtgtggtatacgatgtatgtccctctttaaagtccaaaaaattctgcattaaaaagcacactggtcccacaggtgtcagaaaaggaatgctgaacttgtaacatcaaaatccagtgagcgtttaaaatgtggcatgcacagagctacatattttacatggcttaccttagtcatcccgcaaaacccaattatgaaacactattttatccccaattagaggtgaggaagctgagctcaaagacacatagcccacctaagatcttacaaattgggagtggcagagttggaaattatactgaataatcattacaatatcagtttttagtattttggtataatgtagaatttttataacctaaagaccagtagctttgttaatgcattactatttctttggtaattaagaaaaatctgaactcttagtcatttacactttgaaaaattcccagagtttggctgcattcaaatttgttcctcctagatgaagggaccctttttcaaaaaccctctgactacatctttctctgtttaaaatccctctgagggatattatgatcttaattcccttattaaaggtttctagcttcttgtgtttataaatcatgtatttttcccctagggcagtggggacttatctgcttccagggtccctggtggattcatcatagaattgggaagagggtggatggtcattaggaaaacagaagagggtgagaaaaagaaaggaggaaagagcctgaccatgtcgccgtgtcaggcctggtgctacctctcttagagtacctgattttaagcaaggccttcttcccaaacatctttccagagggactcaagccagagggcaggggagtctcaggtgtggtccctaggccctctctaggagcagtatctgaggacagagtatagaaggcccaggcaagaatagctctctttccatcaaacactgggatttctgacatcgtggctctgctccagtcttgcaattaaaaaattgcattttacctgagcctaaagcctgttctctcagccactggagctcccacctgggaagccccagcccccagcctcgcctgctgtgctctgggttctgaactgcagtgtcctgcctgtcttctgtgtccaggagccctgtggtgcccggagaggtggtggccatggacagacattacttccaaaacactggagcgtatgactctcttatgtcgctgcgaggtggtgaaaacctcgaactgtctttcaaggtatgtcctggaccaagggaggacagaggtgggatctctggagtggtgtgtatggtcacagctcagaggcaggcattagaaatgtcactgggaaggaatgaggctgtgggaaaattataaagtcattcctgtgttgtgtgtcaaacctcccatttctcacagtttcccatctctcctgtgctgtagcttggtttcactctcagtgccttcaaaacctgcttccaggaataggcatactctcagttattttaactgctgtgcggagattccagaggctctcatacattctctattcacagcgctcttagcatcttagtaattttttcacagcacccatagtccaaaacaaatacctgaagttctgtgtattgagtagtttggtccaaacaatgtaatacttgtcataaaaacttagcacctgttgggcaccacacaacttctcaaaccttggagtcaccctcatttcctgtcccacattgcttttctagcatgatacttgctttttcatcacagtatcctccgaaaacccaacaccaaaaaaaattcatcatcaagagtgcagagatctaatgctgaaagtgtgaattacctgacgcttgtattctgcatgaagtccaacagatgtcaccgtgtttctctcaaaaatttaaccccagaccctatgagtttgctgtggcaccctggggcaccttggcacataatttgggaactccagttttggtgtttccattcatatgctgcttatcctaggacagtacttctactttaacctttatcctcaaatgtggaatgaaagtcttcctgccgaatgaactccagccgtttgggagtgggagagcagagggaaatttcttgaaatagtaaagactgtgtctcaggaaagcttgcttctgtctctaccacaaacagcttctggtgtctttgtagcacacttcacaagctttgagatattcccggaccactgagatcatctttttccctgaggaagtgtcctttggggaataggggtgctaattcacatgctacatctctctaagtgctggacctgcatgtgtttgaagggcagcatattcaggtagttgcctggggatggccctcttgtccccattttgggacaactacctctattctctccaccctgtcactcccctgcccagaacctccaaatctggaaactctacgccaccctgaggaccataatcatcttcaccattgagtgctcacgatttcctgtgcattttgccagcccctcatagatagggctccctatttcccgccgttcttaaaggtggaatgctgaggtgtttatcttttcccttcgtggcaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggtaaggagagagccaagtggggcttctgtgtccagcacagggccactagcaggaggtgggccagggagggctcctttctcttgcctggaggggaaaacagaagattctggcttgagcttccctcatgctgccctattttaagtggctcctccacctggtgaggctgtcctttgtctctctggcttctccatgggacagcacagctggccttggcctgaagctccctaacatctatgggatgacatctatgggatgggatccctcacctggggccaggggaggggttggcacagagaagcgatgagatgggtctccaaggccaggtctcctttcatcctgagcaaagggctcagggctatgaaatgatccaagacatgaaacaaatattaaatataaaaatagagtccaaaggccaggcgcggtggctcatgcctgtaatcccagcactttgggaggccgaggtgggtggatcacgaggtcaggagatcgagaccatcctggctaacatggtgaaaccccgtctctactaaaaatacaaaaaattagccaggtgtggtggtgggcgcctgtggtccctgctactcgggaggctgaggcaggagaatggcatgaagctgggaggtggagtttgaggtgagctgagatcacgccactgcactccagcctgagtgacagagcaactccatctcaaaaaaaaaaaaaaaaaaaatagagtccaaaaaagccacagaaaaataaaaattttaaacatttaaatgtccacaaacagcacattatcaattggtcagtggctgctcagcccagtccttccagattgacccataaatgctgtttaatgtgggaaatgggttcacattaatgcttgctgtgctgaaagtgggggctccaaagacaagattcccaggacccacaacagtcctggagcagctcccacaagccccttagcagcccacactgctggggtgtgagttagatgtgagtttgcatgccacagatgaagcctaggccgcttaaatggaaggacatgcctgagtgcagggccagcctgacagggaagccccatagagcagccccagagcttccccttctgccctggtcctcagggcgctgcctcctccccattctagatccaatcctttccctaagtgggaatagcctccagggcctgggatgtgtcagggctccatgaacttcaaggatctttgtttctttagctggggagagtgttaacagtacacagagtcctgggactcaacagtaattcccaaggtctaggcaggctacagtctcctcttggaccccgtcggttagtcacactattaaacagagtggcactggctcctttcctggtgcaggagaaatgctgctaacagcagcctccttcgttcctccaggaaggcattgggattgaaaggaaaactctcacaaggacccagctcacttactagctagcatctttgttcttctttagtctccttctccatcgccatctgtgggaagtggaagcatgtgtccaactctagacaccgatctagaagctgtatagtctgatggttaagcccatggactccaagaacaagatggtttgggtttaagtattggttatatgatccgaaagttacttaaacactcagtgtttctgcttcctcgtttgttaagctttccatctgttgttaggaagaataaatacgttaataaatccaaagcactttagatgagtgcctggcactgagtaagccctgcttgtgtgtttactattaataccatcgttattgtcatggctactaatggtcaaaaaaggtcaaccaagcacctgctctgtgccaggccctgggtgggtcctgcaggggacagagaaccatacccaatgcttatcaggttcttggtggggcaggagctcctctggaagagataatgttcacagaggtgagagtgattcatcctagacagggtcatgacagacatcttttcaggggaggtcacatctgaagaatggctgaatgggttcaactcagacatccagaggaggagttgggggaagactctggagcccctgagggtcaggctaaacagtttagactttattcaattagcaacagggagcaactggccttctacagagttctgtagaggtccacagagcttctctggtttttactctcttgggtttcttttggccaaaccatctatttttctctcttgggatttagtattagctctttgctttcagaggacattttcttaacattggcacagactgcatttgtaaagaactcttaaagaagtgttaaatgttgcatagtttttgatgcgccagactaactttccaccagacagggtcattaggacatggcatgttggctgtggccagcctaatgcaacagcatgcaaattatttacagaacttcaaccttcttcccacattggttggtgcaattagaagtgcctgtgaatatatactttgttctagacaattacagaaattggggactggcatgattttttagagcatgactggtctgcttttgggaaaatccagtttgcttgtccagatggtgattgcaggattttttaagtgcttgtttgtattcacccaagtccttcattctataaaacagaaaactgaggtcccatgagagggtgagttgctaaagagaagtggggaaagaaccagaagtagaactagaactagtccaaccttttagtattttttctctcttagctctctaacatcgaaacagtaatcctcaaatgtagacaccatacttttccagaaatagttggacgtccataaataagctatcctctacagttctgtctgaatttgggggaaggcaaggatgtatttggtatatcgaaggtgctcggctgggcacagtggctcatgcctgtaatcccagcactttgggaggccgaggtgggtggatcatgaggtcaagaaatcgagaccatcctggctaacatggtgaaaccccgtctccactaaaaatacagaaattagttgggcatggtgacacgtgcctatagtcacaggtgctcaggaggctgaggcaggagaattgcttgaacccagaaggcggaggttgtagtgagctgagatcatgccactgcactccagcctggcaacagagggagactccgccaaaaaaaaaaaaaaaaaaagaagaggaagaagaagaagaagaaggcgctcaataaatgttccacagacttacaagctcaaaaagggcaggaagagtatttattctgctgacctttaaatctccaatgcctggttgaatcccatgcacatagtacgtgttccataaacatttattggtggaatggaatggatggatggcaaaaaaatttttaaacctgagatcaacctttggctcttgttatcagtggtgaatctatatggttctgcagcaacctcaattattgccttctcagaagaaagaattcaactgaggggcataaggcagagtgagggaccaaagcaagttttaaagcaggagtgaaagtttattaaaaagtctaccaggagctcaagaccagcctgggcaacatggtgaaaccttgtgtctacaaaaaactacaaaaattagctgggcgtggtggtgtgcacctgtagtgccagctactcgggaggctgaggtggaaggatggcttgagctagggaggtggagtttgtagtgagctgatatcgccccactgcactttagcctgcgagccagagcaagactctgtctcgggaaaaaaaaaaaaagtttagggcagaaatgaaagtaagtaaagtacatttggaacagggccaagtgggggacttgagcgatcaattaagtgcgcagtttgatttttcacttggggtcttatacattggcatgcttctgggggcttgtgtccctttttccctgattcttcccctggcgggggctgttcacacgtgcagtggcctgttagcccttgggaggggagcatgcgcagtgtgtttactgaaatttttcgcatgctcacgtgaggcgttaccagttgcgcattcccggaggaaggtcatgtaccagttaaacgccaccattttgcctcttagtgcacatgcttgagcccacttgcccaactcctgagatcatatcgggaagctgatcaccaatttcaggtttttctatctgttgggagactgccgttccctggtgccagctgcaactaattattattttagagagacagttaacagctgcctaaccaacacctgatggtggcctgacatccctggaggttgggggggtcggggaaaatcctctcctgccctgcttatgtctgactagctacctaataaaacactctgacctcttagaagctattgaccctgtgaaagtcatttaacctctaagaactcagtaactgttgtgagtatactataaaatgaaatgtgaaagagtgctatggagaataagtgctcggcttactttcataaagtctacaggtgaggtacctttttcttcttatatccatttgggtgtccattctctgattcacagatgtccactttgttcatttgatgacttttgcaaggagaatggcacccttattggtcagtgagaagagctttagcagagggctccttttatttctctctctgttgagcatttccattaattcatgctttggaaatgtcctatcacttactttgatttcaaggtttcagtgacattcctacttccctgaaggtatttgatagcatgaatttactttaaatttaaataaccaaaagttaattttgccctaaagatttctatttctccatccaccccaaaacccccacaaggattctgagagacagaaatcctgggcacccaaaagacaaggccagacttttgctgcttggggagctgaaatttccttgttttctcttctctcagacataattgtacagaagggaaagttcattgtcagcctgcccctcactcaaggtcaaacaaagattgggtagatttatcagtttatctctttatcaaggaaagtaaaggtgataaaactcatatgaagaaatgtttctgttttggtagcaaagtccaactctgggaaaggtctacggaggtctcaaataaacacaaagaatgccaagaagccatcaagaaacttatactaatttacttagaggaaaaagtaatagatccccttggtttcatggtgggtaaatacactgaataaacaagaaatccctgacttagagaagtttttctcaaactttgtgtgaaaaagactcaccaggagacatggttaaaatgcagattccagggcctccaacccaaacaactgtatcatctctggggcagggcccaggaatctacatttttaactagctccgtggcatttctcaggcagatgctcagggaatcacactttgagaagtgtctagagagaatttcagtacaacagacttaccacatttccagctgaggtctaaaagagagagggaaagcagaaccaaaccaatcatactttacacagcctggtggacccgtgtcttactgtcagattggaggccaccaagtgggaactctgacatggccagctcgcttcctctccccatgccaggaaagggttctctctttttttgtctgtggtcattccaacccatccttgtcacctctctcttccctaaaagtatccaagatttggtactaaacttttggatacagttctttgtatcatcaatatggccaaaaacattaatttgtactagtgttcaggatttgccttcatctccatcctaggacaattgtatcataaaggagaatctcaaaaaaaggagatagtgtagcccaaaagaatgattcattaatggtacccagaggtgaagaaagataaatttgccttgccccaacccctagcccacgatttcccaaccaacttcatctcaattgcctatgggtcagttcctgactccatgaggcccctcgtagtttctccttacaccaagctaggtgcaaagccccaccattttgccagcttctgcagaaaaatcattaaagcacagatatcatagactctctctctctctcttttttttttttttttttttttgcgaggaagtcttgctctgtcgcccaggctggagtacagtaacacgatcttggctcactgtagcctctgcctcctgggttcaagtgattctcctgtctcagcctcctgagtaactgggattacaggcatgcgccaccacacctggctaattttttgtatttttagtagagatggggtttcaccatgttggccaggctggtcttgaactcctgacctcaagtgatccaccagcctcggcctcccaaagtgctggaggtgtgagccaccactcccggcctattgtagtctttatagactggagatttgagggattgtgggaaggggctgatatcacttacagtcttgctggttccacaactctctgtagggaagatctgtgctattctatcccttccagaccttcttctcccaacacatgaccctccccactgcagccctggagaactgtggtcttggccccttccttctgtcctgatcctttagcttcttcccagccactccatccccaaccatgtgaattctgggcaagacaagctttcatcatcctgcttgtgtctttctcctccccaggctgagaagccagactgcatggaacgcttgcagctgcaaaggagactgggttgtcggacattccactggtttctggctaatgtctaccctgagctgtacccatctgaacccaggcccagtttctctggaaaggcaaggcatgacccagggaagatggggagggacagggaagcttcccaagacaagaactagatgttcagctcttccatgtccctggtcaaccattcacggtttagcagggcctcagaggccttgggtccatcccgtgcctccatgccagtctgaggaaggtggctgagttttgccccattacccaccccaaagcacctccttcaagaggcctgtcccttagggtcagtggcttcagctttaccacacctgttgttgtggcctgaacaatgtgccttgggctgcactccagagaatacagcaaaggaatggtgtctgaccgagggtgtctttacagtggaatctggaattcactcctgtgtgtgtgtccactttcagctccacaacactggacttgggctctgtgcagactgccaggcagaaggggacatcctgggctgtcccatggtgttggctccttgcagtgacagccggcagcaacaggtgggtagtcagacttctcaggatggatgatagcccaagaagacttgaaagtgggcgatatttttctgggatgccccatacttccctttgaggtatcttctttctgtggtcccatgtcccttgactgccatggtcccccactgtaatgactcatcacagctctcctcacctcacctccatctgtaagcacagacatgtgccattgtcagaaaataaaagcatcttagttaaagggaaatggagaagccgtttggccaaacttttcatttgacagatgagaaaactgaggcttagggtcactagcccagggattgcaaactcagaagcctccaggattcaggcagggttcagttgtcccaggactgaagaagaaggtaatcaaatcaggataaggatctagagaaaacagggtcatcccagcctccagcaccatttggtcattaggaaggtctcctcatatcttaggagtaattcttctcttcaaaattttcatcatggagtaactgcccaaagtggtagaaatcctccaccgatgctagctgagggctggtaggtccacttcttttcacaactggatcacaacctagaaagcctagcttgtccccaagtctctctcttttcagggtgtgatagggacttttaagttatcacatcccaaaggcccctaataaaacaaacatcaaagtataatttcctggagatattcactggatgagaatcaaagatctggggggcaaaagacagcatctctctgagggtctgtggtccagccctgcatggaaggctggctgaggctgggcttggcagtgcaggccctgggttcctgggggcaggctgtgggcctataggacatgtgggagggagatgctcaggatccatccggcctcctttggctctgccctttaccaatctcctaggacatactgataggcattcacacctggcacaagggatgcagacataaacatcaagtgctaagtgaagaagccacatggtagggtgaaaattgttcaagctttgcagtcagacatagctcggtttgaatctgagctctctcattttctagctgtgtgatcttggcaggcttctttaaatcctggtttcctctcctgcaattaagaataatgcagcctctacagagattattctgggtttgaaaaagaagaataaaaaaaaaaataaagaaacaaaagaacaatacagcctccttcatgcaaaaggaatattagctctttcttgttctttttttttttttttgaaatagtaaggactttaggatcctgcaatattgtaaactagaaaagttgaaagcctttccctataaacacctagataagatatgccagataaaaaaatatgaaacaccctttttcatgaataaacgagtttataagaaagaaagggaaacctccaggggtcaaaaaacaagaggcaactgaaagtagaggaattggacatgggcgaagctgccctaccaagtgtgagggatggttactatgagccccgggaatctacagctgttggctgcatgcaagggataagtgacgagagcccaccttcagcccatgagagatgaaaagtcagaaatgacacccccatagcaagccagctttgaccttcaaagggtaacctgtccttgaaaagtttgactagaaatacccaccccctgccacaggaaaatggtaagaagcttgtccctacaggggctttgagtaggaaacaaattattcttccctgagaatttttaaccacaagcttgcatctaatatgggcttaggttcacatgtgtactaattgtgtagcttgggaatcctcaagcaggacaggttatctaattgcagggcccagtgcaagatgacaatgtagtctttaatttgacaattattaagaatttcaagacagtgacagcagagcattaaatcaagtttattaaacccatctaagcatgaggccccatgtgactgcacaggtcacatacccatgaagttgatcctgtctgtaagccacaaaattaatgtagaaatgggttcaggctgcatctgacagaaacaaacagaaaatagtctttccaggacatgacttctaattaatcatcacaagatcctcacagttaaagcccctctcaaaggtgtgcacaatccaacactacaaaacactagaggaaacaataaccatgagtgagagccagcagatacaacaaacggcaggaaagttagtttcaggagcaggttagggctctccagaaagacatcaacctgggcttcagagaggttcctcatctgtgctttcaacagtatagtaacaaaacacacagcactttttatggcctcacctatgatacggtaaataacgtaacagagaaacatgccagaatgtataaatatgaatgtaagagcaggtggaatgtggggacttcagaggctatgactagtctagcagcatgtttttggacttgaccatgagatatggtctttctgaccccgatagaatctgaagattgcccctagacctcagctctatagtgggttcttcttacctcctctacagctttgaagaggatctctttctagctgcgctaacaactattgcttctgtcacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggaggtgagtaatctgttcaggaagagcctggtagtgctgctggtcagaaggaactgctggttggcattggatcctgggctcttccaagaggtcaggtattagggacctctgcctctgcttttgaacttagtggctgggcagtaaggcctcagggggaggaaaaggcaacccagcagcaaagttggcccactggcatcttcatatgtaatgatttgccaggtctctgtgtagctctgatgcttgtcattgcagagagagggatacacctctttttgaagtttattggctcagttcacaagtaggatggtgaggcatgttacaaggaacgttcagccaccttggtggtgtggttttaggagcaattcaaagtccctccccccaccaagaaactttagatacagatgtagatgtaaatatatagatatatagatatcactttcttcctttcaatgcaaattgcactgtaagtatttcatcattttagtaaaattttgacccctattaccctgggggaaagaaactatagatccttcccagaagttagggagggaataggaggaatgtccgtacttaaggagagtgggcaggtcctatatacagaatcgggatcggaagatgacagtatcaacactgtgtccatacacagctttttctctacttcaaattcttcctgaaatgagttggggtattaacatacaaagaaataaatacacaccttttaaaaatttcttcaacttctgctggggaataaaaaggataaaatgactaagcagaatcctgtgcattggtactcttaaagcaggctgtgaaagaagaaaatcgtatgatagaaaacttaagctaagctcacaataagcacttgagaacagagcatttggggctttggtgaccaactgaaggcaggactcaaggggcccacacatgctcaaagaagtctttttttttttttttttttgggacagtgtctcactctgttacccaggttggagtgcagtggtgcgatcttggctaactgcagcctctgcctcccaggttcaagcgattcttgtgcctcagcctgctgaatagctaggattgcaggtgtgagccactgcgcctggctactttttgtattttttagtagagacagggttttgccatgttggccaagttggtctcaaactcctgacctcgggtgatccacccactcggcctcacaaattgccgggattacagttgtcagccaccatgtctggcctcaaagaagtcttatgagtcaagttaaggtcctttataaatgatcataaagtatttttctaagcaagtcctatgaataagatatactttagaaacagcatttaaaaataataagtaaaataagtaataatgagtaaaagattagggagtaagatacacccagcatatttcaggcattaataaataacttctaaaagttattatcattcagccagaaaaaggaatgaggtactattcatagtggcactgttgacaatagccaagaagtgaaagcaacccaggtgtccaccatggatgaagagataacaaaatgtggcatacacatattattcagccttaaaaaggaagaaaatcccatcacctgctacaacatgggcatatcttgaggacattatgctggtgaaataaacccatcacaaaaggacaaaaactgtatgattccacttttatgagatatctaaagtagtcaaattaatagaaacagaaagtaaaatagtggttaccagaggcaggcagaggaggagaaaaagggaatttgtttattaatggttatagagtttcacttttacaagatgaaaaagttctggatatctgtttcataacaatgtgaatatatttaacactattgtagtaggctattcttttttttttttttttttttaaagagggagtttcgctcttgttgcccaggctagagttcaatggcaggatctcggctcactgcaacctctgcctcccgggttcaagcgattctcctgcctcagcctctttagtggctgagattagaggtgcctgccaccatgcccagctaattttgtatttttagtagagacggggtttcctccatgttggccaggctggtctcgaactcctgacatcaggtaatctgcctgcctcggcctcccaaagtgctgggattacaagtgtgagccaccacaccaggcctattaggccattcttgcattgctataaagaaatactagagactgggtaatttataagaaaaaaggtgtaattggctcatggttctgcaggctgtataggaagcatagtggcatctgcttctggggaggcctcagagagcttttacttatggcagaagatgaagtgggagcaggcatatcacatggtgaaagcaggaacaagagaaagagagtgggggagggggtgccacacactcttaaatgaccagatcctcaagaactcgctatcaagaagacagcacgaagccatgagggatctgtccccatgatccaaacatcccccaccaaaccccacctccagcactgggaattacaattcaacatgagatttagggaggaccaacatccaaactatatcaactactaaactttacacttaaaaatgcctaagattgtaaaagttttgctatgtgtttttatcacaatttttttaaaaaagaggccaggctcaatggctcacgcctgtaatcccagcacttcgggaggccgaggcaggtggatcacgaggtcaggaggctgagaccagcctggccaatatggtgaaaccccgtttctactaaaaacacaaaaactagccaggtgtggtggtgcacacctctagtctcagctactcaggaggttgaggcaggagaatcgcttgaacccaggaggcagaggttgcactgagctgagatcgtgccactgtactccagcctgggtgacagagagagactgtctcaaaataaataaataaataaaagaaaaagaaaaaaagaagaaaaagatttgtggtacaacatggatgtaccttaaaaatattacacacggtgcccaacactttgagaggcagaggtgggtggatcacttgaggtcaggagttcgagaccagcctggccaatatgggtttttagtagagaaaacccatctctactaaaaatacaaaaaattagctgggcatggtgtcacatgcctgtaatcccagctacacgggaggctgcagtaggagaatcgcttgaacctgggagatggaggttgcaatgagccgagatcacaccactgtactcccgcctgggtgacagagcaagactccttcttggaaaaaaaaaaaaaaattacacaaagtgaaagaagccagtttcaaaaggccacatttatatagttccatttatacaaaatgtccagaataggaaaatccataaatatagaaagtagattaatgattagtttctgggaggagggaggaatggggagtgactgctgatggacagtgggtttctttttacgtaatgaaaatattctggaagtaggtaggagtgaaggttgcacaactttgtgaatatactaaaaaccaccaacttgtgtactttaaaggggtagtattatgatctctatactagtctgttctcacactgctataaagacatacctgagactgggtagtttatgaaaaaaaaagaggtttaattgactcacagttctgcaggctgcacaggaagcatggctgaggaggcctcaggaaacttacaatcatggcagaaggcgaagaggaagcaagccccgtccttacatggcggagcaagggagagagagagcgaaggaggaggtgctacacacttccaaacaaccaatcttgtgagaactctatcaagaaaacagcaagggggaagtctgccccatgattcaatcacctcccaccaggcccctcttccaacactgggaattacaattcaacatgagatttcagtggggacacagaaccaaaccatatcaatctcaaacattaataaatgaatgatgaataaataggcattttcagcattgctggttaaggttgttcaacttttcataaagtaattaaatttttcttgaaaaggagaagattggagtcaatattaaatctggtggttttgagcagggaatagccatggtcttctgaacatggctggtttagcccttcagtatatcctagaggtcttgctcactaccacagcctggtaacaacagtgcccaactgcaggattaacagaaggtaaagtggattaaatcgttttgaaagcagaaatttacaactacagtgataacaatgaatgtcacaaatacagcataaagactgaacatgctctgggaattatactaaccataactttctaagaaatggtgcaattacacaactacaataaagataattggattagttacccctaaggttttgagtgacatccaaattttagggctacctaatttatattttatgttgatcaaaataccacaattcctttccaggccagttcacaccatctgttattctcttaatgattagcacaaatcttaaaaatattttcttttgctgactgattgtgggggactggttttcttttcttttttcctttctctttttagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgcataaattgtattaggtggcaattaacaaaaggacccagatggcttattgcctaattgggtgaacaaagcaagaatatggtgtttcttgcttccttaaccagctccatgatttattactttattgcagaagtggctgtcaactcagtccctggctggtatttacagacccttaatttaagtaaaacagatgcctccatttagttctagaaggaccttctcctttagtgtaaccaagtgttcaaattcccttcttctctatgaactcagcattcattttatccataatgatcaatttaaaagtagagaaacttgtcagttgagagatctgattcccaagagattggtttcacttgtctacctgaattttgtgattggattttgttgttcgttttttaagattgaattttgttaccacccccaccaagttcatcatcattattaactataccactggggagaacagagagaagtgtccggccagcagtctagagtcccacactcttcatgctgtattacaacagtaagagcagatatccttcctggagagtgcctgacctgtttcctctttggttttaatgccatagatcccactggaaaattcagaattccaactaacaaagacatggtggttgaaaagtcctcagtgacaataatgatggcaccactgcagcagaacttgacattttagaggtcatgttattgtgcttaatgtgagggggttctattctctactgaaaggctatgaaaaagccagttggacaccaagtgatctgtgaccagtcaccaaatttggacaaacaaaatgcaaacaagttgcatttttaaaaagcattcaaaaaaaaagaaaagaaaaaaacaaggatagtgtacataatatgtagagttgtgcaaacattgtgcaaaacattgatacaggctgccttgctgggcacaactctacttattatgcacactatttatgttgttctttcgaagttcttttaaaagtgcaaattgtctgtgatcacttttgggcaaagcccaaagcacctacaagtcctgcctcgattattcaaataccttgatttgggcatatttcaaatgatatgtcaagcacaataaccaaggaggtgctatttccagaattctagacccctctaccattcctgtattaataatagtccctccattggataaagaaaatgtggcacatatacaccatggaatactatgcagccataaaaaagaatgagttcatgtcctttgcagggacatggatgaagctggaaaccatcattctcagcaaactaacacaggaacagaaaaccaaacaccacatgttctcactcatacatgggaattggacaatgagaacacatggacatagggaggggaacatcacaccagggcctgttgaggggtggggggtggggggcaagggaagggagagcatcaggacaaatacctaatgcatgcagggcttaaaacctagatgatgggttgacaggttgataggtgcagcaaaggaccatggcacatgtattcctatgtaacaaacctgcacgttctgcacatgtattctagaacttaaagtaaaataaataataatagtccctccaatctcaaatcttctttccagttccaactccttcttacatgaaatgtgctctttggacatggccatatgtcctaagcattgttttaatattatgaggatctttgctggagtagtagttctttccacgggtatgggatgtttatattttttcatcactgaaggctctacgtaataccaatacactaagttatcacgacatataaacagcttgcctgatggtttggcttaaaaaaagaatcatcagaatcaccatgatgactttacccctagggtgatagtttataagctcagtccaaagagaccagattaatgtttgaaaattaaagttccctaacaattcccaaactgttcagctagctcatagtcaatggacattccagtacctatgacaaatgctaaaatgatacagtccttcctctctctctccctccctctctccttctctctcaggatgagaacagggccaactctgctgctgctgaagcttatcaaaggcctttaacttttcagcagattgtgaacaatgggtaggacatcatttgcttcattcagagatcctcaagaaggcactgccgatcactctcctctaggcacagatcaagggtggcattgtttaatgtcttatttaaataaaatccagaaaaactggagctgctatctttaaagtcataacttgcccagatgcaccaatgcagaaactgttcagagagggtgaaaggtgagcacctcattagattatccaaaattctccaaaactctccaaaattctccaacccaaaccatatggctatagtgggagctgccttgttcccaccataagatggcccctcctcccagctgaacatctgacccatgttgggccaatcagcacattcctcagtaattttgttactgagactaagaaatcagtctctctaccagtgacttaagagataatgtgaggttgggcatgttggctcacgcctttaatcccagcactttgggaggccaagacaggaggatcgcttgagcccaggagtttgagatcaggctgagcaacatagtaagaccctatctctacaaaaaacaaaaccaaaacaaaaattagccagtctcatagcctggcctcaaaataaataaataaataaatatatatatatatatatatatatatatatatatatatatatttatttaaaagagacataatgtgagaatgttgagctctcagcagccttgttttctgtatatggtcctatgaggtagataaatccagtctggagagtgaatcagagacagctgtgggggtggaaacaaatataaaaagagcagaggcaaaggtgggacagagcaccttgatagtatttgatccgctggctccagtttgttccccaggccttgatagatccctgtccctggagtgtgtgagacaaccggaaatgattttgtttaattcagtgctcctcaaattttcctgtgctcacaaatcacgtggggaccatgttaaagtgcagattctgatttggtaggtctgtgtggggcgtgagattctacattcctgcaagctcctaggcaatgctgatgctgctggccagagaccactgtctgagtagcaacgattccagtagttttctgggtttttccaaattgttacttagagctcagaaaatcctcactggatgagttcttggactgttttttgcttctaacggatctctttttgaagccacatggtaagatgatttgatcctatgtcttacaggataatgcatctttttttttttttttttttgaaacggagtctggctgtgtcacccaggctggagtgcagtggcacgatcttgattcactgcaaactccacctcctgggttcaagcgattctctgcctcagcctcccaagaagctgggatcacaggcgtgcatcaccacgcctggctaatttttgtatttttagtggcgatggggtttcaccatgttggccagtctggtcttgaactcctgacctcaggtgatccacccacctcagcctcccaaagtgttaggattacaggcgtgagccaccacgcccagccaggataatgtatcctgttcaatgtaataacaaccgttgttaattcattttcttcttttccctcagcattcttcctctttcccattctgtccactagttctgcttttttgaccagggaagttttttaacctttttttgttgttcttgctatttgtctgtggtcatgtcgtccctccctcactttctttatctttccccaactttcctctacttctcatctttgagcaaacctgcttttccagcaccaggtttttgtggtaatttttattccactcttacttttcctctatctgggcctccatgcccttctgccaccagtttcaactgactaatcttgatggagtgaacagcatcaatttctccaaaggatttttagaacactgagcaaataaattaatagctcagattttcagctcttctcagtggcagcgcttctcctgagggaatccatagtgtgggggtaaggaaatgccatttaatatggatttggaataacagggatactgagagtgctgccaatactgatgggaatatggccctcatcttgaggaggcagctggggttctggcaggcagattaccctatacagtggattttcatagaggcaagtataggggactccctggagatgggccaggacttgtagcctctgaaaacagccacatctaatagctaaacatgaaattaggtgattggaaaacaaatcctgccaaagcccaagatttgattgtcttaatccttaagtcctgcagtaaagttaaagcatgcataactaagaaagagataccaaatttatcctctaacaccagaggctatagtagtgacactgagtgttctggccccacccatatccctctggtcttatagctttagctttctctgaaaaaaagttccaactgtcagttatctgcatttcttcacctgggtttctttttttttttcttccgcgaaagccaaagaagactgctttatgatgtggggaaggccagaaaagccttggaagtcacattccccagaagcagtcctcaattgatgactgacaggagttggtgtataaatacctcagctccctcacctctcccatgggatagctctgaggtgcatgttctacaccattccccacagtgtaccatgggattaagctctagtcacccacagtggtagctggcttgataatgcatctttaactggctacattcccttctccacttccttactagtgtttcctgggctcatcttccaagtaaaccacttgcacacaaatccttatctctatgtctcctaatggggaaacccacccaaacacacatggcttgtcccaacaaaagcttgcatctctaagagttatctttcttatcacagtttaagctttgtttcaccagtagtctcaacccatgcacaagataaccccattcccctgagttgaacttatcctacaaactgcaaggccacagtatgggcttctaggcagctgtgcccaaaagaaaagagtctgggggaggggcaagatagttggtccttatcccaatctttttttttttttttttttgttggagtctcactccgttgcccaggctggagtgcagtggtgcgatcccagctcactgcaagctctgcctcctgggttcacaccattatcctgcctcagcctcccaagtagttgggactacaggcacctgccaccatgcctggctaattttttggtatttttagtaaagacagggtttcaacattttagccaggatggtctcgatctcctgacctcatgatccacctgccttggcctcccaaagtgctgggattacaggtgtgagccaccgtgcctggccggtccttaccccaatcttattataacattagacatccttcctccctggggaaaagtgaatatggagtggagagaggccatgagtgttccactaattgatgccccttcttgaagaaacctgaagcctgatgaagcaaggttcctccggcctcacaaaaaatgttccccctcatatttcagttattttcctataactgatacataccagtgttagaggatatagaagtataccatagaagttaggagtgaagtgcatgattgctctccatgataaagcgagggagattcagatatgagtattgaggaagcgatggattcaaacaatttgataaagacataaagagtgagatgatcaagaaggtatctctagtgagggcaggagtgacttaccagagaaattttaggattaggtgtctagtcctcaatataaagttatttgccttatttccatcaccccagacttttagttaagacttccataatgactttcgtagtatgttggggatggaaatcaaggaacagggataagtccctggacaggacaaagaggaaaagagcagccttgccgggtaggatagataccagtaagactaggcattcaggtcaggtgtggtggctcatgcctgtaatcccagcactttgggaggccaaggcaggcagatcacttgaggtcaggagttcgagaccagactggacaaaatggtgaaaccctgcccctactaaaaatacaaaaattagctgggcatggtggcgggtgcctgtaatcccatctactcgggaggctgaggcaggagaatcacttgaaccagggaggcggaggttggagtgagccgagatcacaccactgcactccagcatgggcaacagagcaagactatgtctcaaaaaaaaaaaaaaaaaaaaaaaaaaaggactgggcatcagtggaattagaactcaaaggccagagtaacagtggtatggagaagaattaatacagattgttgccacataccaccaaagagtgccaatcaggatatttcaaaattatgttagactatgaactagagtggggttagcaaaccttttctgtaaagggctagataggaaagtgctatacactgtttccctctttttttgcagactctgttaactctgttaactacttgactctgccattgtggtacaaaaggagccgagccatggacaataatcaacaaatgaccatggctgtattccaataaaactttatttacaaacacaggtggttggccagatttggccaacagccatagtttgccaccccctggactacagtatttgactcaactgtaggagacaaattacagattacttaaaaataaacagagaaatattaccagcgaaatagtgaatgagctttaaaaatataaaaataaagtgtttctctgttatacataacagaacagcaaaaaataacaaaaaaagagggaaacagtgtatagcatatgttctcattatgagcacactccagtcctttttataaaaaagtaggaataagcaaattatttttaaaaatcaaataataaaacattgacactgtagtccacagtcttctttctttgggggacataaagattccaggggccttcactgttaacagaggttgagcaaacgagctttcttaatgagaccacagctgcaataagaacatgaacatggaagggagggctcctcagaagcacagagtaactctcagtatcttagccaagccaaagtgattaaactgtgccaagagatacagtttaacactctagtttttatcttactgtggtgaagacattcacaaagggcaaagcacacgctcccgctaacacacaaatcttttgtgtttgggatgtaaggacaatcagacacaagctctggtgtaggacaaaagcaataacctctggttatttatataaactctgatctctggcgttcaatttagccagacttcaaaacacaaatggtagaagtcaagccaaggaaagggacttccaaaagcaagccttgaggccagggctataccaggccaacaaaccttactccttgtgctctgaagccaatacaagctcataaaacctgtttaacagccaagcctagggtgcctcctgcctgttatgatccatgcttagggctgtccagcccatcatgccccttcacatgtcagtattggcatatccaaggctggttccagataaaacaaatggcctgaggcacctcaccctcctcacactcatggacagttccaagctctccagccctacatctactttgcattctgttgctctactggccgtgctgctgaccccagctattatcgtctagtgagccttcaccatgcacaagggacaggcagctgtgcagatctgagtacccaggtggaagccacagttgaggcctattgacttttatcttagagataaagtcctgttcccccaccactccccagtgtgggtcatatgtaaaggaatgtaactctttgagagtctccagtcaactctttgagcatatccttgaccactctccttgggaggccctggcacctgggtctaggtagtgggttggtttgtctgatggtggagccaccactgtctccttgaggttcccgctccctgaccctggctataatatcccctcacagactggtttacgcaatggcctcacccctcagcttgtcaggtattcaggatcccccacctacctatctgctacctcctcacctaatctctctatccagatgacgctagccttgcaggtgggatccagatggacaagtgatatgtgttgctttaaggtggctcttttccctacactgttattcagtacggctctgcagaattatcttccagaataagttataggcttcttttagcaaagagccatggtctacacttccttattttcctcttagcagttaccatggagttggttgcttgacttcgtggattccagtatggaggagaaaaaaccaggagttaggatatagaaaaatgacatttcaagagttgggagaaaaatcaactagagaaaaatgtggacatcattagacagtaatatctctgtgaccaaacatatgtattcactgccagaaatcatagtaataacaacaaccatagtgctaaggctgtactaacttactagcacatactattactatgataatagtaataacattaccattgttagtactatgtactattactattgtaatgttgttacaatattaacaacattaatattaatattgttgttaatattgtaacaacattgcaatagttgttgtactcaagttattttttcttataatcacaataggccaatgatgtaaggactactattatctccgttttatattatctcattttatagttgaagggtgaggtttccacaggcagagtaattttcctaaggctatgcaacttccaaagtgatggacctagatcacaaacccagtttcatttggttccaaggccttcacatttaacttccacatttgattgcctcccagtatttgtgagtaaagaaaataaaacagggactgtccaaatgggaatgggtaaaaataagggccaggttgttttaggacctgccaaaattaggtgcattggtttggatgcattcaggtacaaggagcagaataaccaactcccaggggcttaagaaataaagaactttagtcatctcacatgcctagttgaggacaggcagttctgtgcctggtacaatggcttacagacacctatgatccaggctctttttaaacttccactcaccattcctgttggcttttgatcctggtttctgtctctttaccagcacaagatggtcaccacaacaccaaacatgacatcctggccccagaatcccaaacaggatggagagggcggcagaagcaagttctcctcattaataatgtctttctcttcactgagaaagcaagatctttcccagaagccccccagcagaccttcccatctgtctcattggccagagtcctagcagcaagggtggctgggacagtggcaaggaaagtacctcagcaaaggctgggcacattgccacccagaacctcacaaaggttctgcaaaccaggaagtgggaagttggcagatggatggccagtgacagtacatgcattttgagatgcctcctctctcaggcaagattgggctcagcttctttttttaatgtcatgggatgaaaactgcaggacactgagacagagacctataaaatcctgtgctcacaattcctgggtattatccattcagctcctgccctctgcccaagtaggaaccttcaatgccccagaagcagctccgtgtactcagtttgggatatgaggaaagtgcctgccatctggaactcagccactgctatcataatcggtcaaacactctgggaagcaatggtgttctgatttcttttactgcacagcttccaataaaatttgtggcccaggtgtgacaaccaatagaactctttcactttattcttgtctctgagattctggtttctacttgctttctaaaagaaacataaaaggcaagtaagcatggcgtgtaaaagtgaagggggtgggcttcccatgggatatatgatgattttcttcctttgttgtaaacatatgatataggaagttgcgtgagaatcttgcttaaaacaatagtgacaaccttttaaccccatctgcttcccattaatgggaaaagccgttacatggtagtgtcaaggggcctctggattttctcaaggctttaccataagacagatgcttaagacaaaatcctccaaccctttggttctaatcctccccttcttagtccattcagaaagcacagaaggtaatggcatctggccgatactcatgagggctgggttggtaaagtgaaaacctttctgtgctgtgacaaatttcactggctgtgctttaggtagtttgcaaagcacaaagttaagtttctggatgatatgttcatgattaacaaaccagattataatgccctttccagagtgaattctagttcttaggattactttgcagatttaaaaacaataaatatttattaaatatctgttatttaccaaggtcacacctctagggccttgtcccgtgtgttttctgaaccactggcgtggatgacttgatgagtcactcatgaatcagaaaattgcaaaatatcatcttcactgaattttatgtcagcacagactcagtcagagttgaatatggactccctggtttctgggaaggcagagatatttcaaaaacatttccaggaaggcaatcaagtgctccttttgatgcatttgccaagtgggacacaaaatagacctatatttgtaaataacaatctttttcaaacactgccatggggatatgcccagcttatagtgatccttaaaatatgtattgtgaagtaataatccacctatgtttcagtaatttccaagtgtttctccagccttgactccaaccatgaacctcagattcacacactcaagcaccttcaatctacactagagcccgagtaatcaacctaaagcactctccttccataatctcttctatgactccgcatcaccttcagagtaatgacccgcctccccagcacagcctgactacaagttcctccctgaccctgcctccaccctctggactcacctgctactatttgccccatctctgaacaccaaagtttttgtagttcccaatacaacacccttttccttgtctctgctctaaccatgctctgttccctctgcacagaatgcccttccctccgtttgccagcttcttcttacctatcatgcatgactcatatacatcatgtctctggagggtcttcctcgaacccccgggctgaattaattacccctcttctggagcactgcatatgtagccctgtcttaacatggaccactttgtgttaaaattatcaaaaagatgtttcctcctctggactttaaacaaattttgcttagctttttgcccagagtccctagcatagtatctgactcttgacaggcacgtaatacatgcttgttgaacttcaactaaagcgatcacagcatctttcttttgtgcctagaaacaagcagaatgaaagtggaaaagaaaaattacagagctaaaatttagacactgaagaggtcttatttgaggtcaaatttaagaggactttgtcctgatcactttttggatggctttagactctccacatgtggctgtagcaattccagactcccactgcactgttccagttatcttttgctgcataacaaactaccccaaaacttagtggcttaaaacagcaacttttttttcttttttttctttttgagatggagtctcattctgttgcccaggctggagtgcaatggcgcgatctcggctcactgcaacctctgcctcctgggttcaagcgattctgccgcctcagcctcccaagtagctaggattacaggcacctgccatcatgcctagctaatgtttgtatttttgtagacatggggtttcaccttgtaggctaggctggtcttgaactcctgacctcaggtgatccactcacctcggcctcccaaagtgctgggattacagccgtgagccaccacacccggccaaaacagcaactattatggctcatgatcaactaggcaagtcctctgcttcatggggctctaactggtgtcacttggtggtgtcagctcatggctgttcttttctggagggtacaaaagagcttctcacatggcaggggaggctggcaggctggactcagctgggccctcccctctccatataatctcaagacttgtctccgtcatctctgtggcagctatcttacacagtggttgaacatctccagagaccaacaggatttctgccagtcttcttaaaggccagacctgggactgacataacatctcctccagcatactcctttgctcaaagcaatcacaggccagcccaggctcagggaggaggggaagcagaccccacttatcaaagggacaagtagcaaaagtgtgcagctatccttaagccaccatgcctgcaggcccagtggctaagactgagtctatgtcccagaatccccagcaaagctctactgtttactctgactgaactgacttgcagaatgcgtctgcccctgaactaatctctgtgaccaggagcttgggaaatcttgattagagctggaggtggaaacaattttggccaatattatggttaagaaactctgtaggggctgagcgtggtggctcatgcctataatcccagcactttaggaggccgaggcaggcaaatctcttgcgcccaggaattcgagaccagcttgggcaacatggcaaaaaccaatctctaccaaaaaaaaataaaataaaataaaagtaaaataaaatacctaggcattgtagcacatgcctgtagtcccagctactcaggaggccgaggcaagaagatcacttgaggctgggaggtcaaggctgccgtgagccgtgattgtgccactgccctccagcttgggtgacaaagagagaccctgtctcaaaaaagaaaagaaaagaaaagaaaattctgtaagaaggaggtggtggtagggattgctgggtaggtgtcttagtttagggtaatgtaagtgcagaacctgagcaaggccttggatgcaggtgatttatttgggaggtgatcccaggaagcaggagtgagagagagggaagagtaagataggcagggaagaaaagtcaatgtaagggtgctttgagcaatggggttcgattctttctactctgagatgcccacagaacatgttccagaactatctacctaaagaacaccagactgagacattttcccaccagctctcctctcttattggttgagggttacacccggggccattcactccctgggatacactttgcaggctgcacttgcaagagcagaccaggctcccaaggctttagagaagaccccaaggcagaaatgtggagagggtggggcttgacctggatgtcgtgcaagatgaatctaagcccccatggaagttcggccagagctggggctgatatccaaggaggcccaaggatgcgacactggacaccgaaacatctgcaataagagccaaccaacaaaggttccctcaggtcagagcccagctcgccttgccaaatggctcccagagatcacttctgcagctgatgcagtgggcgcccagggagcacctccttcctgtgcagaggttggcactggccagcttcccttggggctatgcccacccgccagcaccaccaggaacatacctctgggtgatcaaagttaggtttattggcaggtgtagcaaggaagaccacccacatgaggaaccatgggtgtctcagtaggacagtgtccaaaggagcttctcaggaggtcagggcttgggttaggtgatttgggaaaagattgggaagcatggtcttgctagggagctgtcagaaactgggacaattttataaacgggcatcctaataatttgtatctaggtgattgtgggaagaacagagcagggctggagctgtacttgataaacacccctcatatttgccaggagaaggagctatttggtcattttcacagtgtgctgggtgttcttatttcagtgtggtcttgttgtctcactccaccacagccacagattgaccttgtctgatgtcgtgttctgtgaagttgtgtatgttaagtaaggagcgggctccagtcagacctgggggttgatgactttttctttctcaggtctcataagacacaggctctgcacactcagaagagtggcaggcacccatggtaacacagctgcatggctcaaagtaacaatcaagacagaagaacaggcaccgatcgataggactcttctatctcctaaagctcttttgaagtctggcagagacgtttgagtggcttctgtccacctcctcagtgactcacagtgcgatgctcatggttgaacctgagtgatgccagcagcaaggaaactgacagagctcgccgatccatttcctgtcattcacttgagggtgacaaagcatgatggtgacagctcagataacattcctggcacaaaatccttaaactaaatggagcctggctgccaggaaggagaggaacaggcattccaggggcagactctgctgctggctgcagccacacaggagagctttaaacaggattctgaacttagagagcaacaggatttgtgcaccactgctacactgatcaatgccaatagttggcccaggctggaggatgggccaggcatcctaacgccattgggcaaatccaaggtttaaggaagtcagcacagttggggtacacactagagaaagctacatgttttgaagaatgtgcagactccttgagcccccacaaagcagcctcaccatcggcatgtagacagtgcaaagttgaatgagaatctcattagaacttctggaagctcatctctttcttaccagacccatgcttaagactggagtcctggcagaggctaatattccagatatgagccagagacaacctcgtctgtgccaggggcatgtcacccaaactgaggtcatataatttaaaatataactccaaagttcagtaaggtatggcggagaaacctctggtgcctgtatcacatgtcctcaggccttctctgctttccgccactgctgctgaacagttctgtgcagcctcagatcccctgagccctgtgctaagtgtcttctgcattatgcaccagggttttctctgaaggcagagttactcaaacatccagggagcaagcaccctggcttgctaggacagttaacactcccaggacaactctcagtcactgaggggatgggaaccagtggatggatgtctggcctctgtctttcaggtggataattatacaacgcatcctgtatattttttaagagggtcaacagaatcaagtggcaactttaacgtgtccttatattggcgcctccttctgccccatctcacatcctcactcccacactcctgcttcccaggttcacacccctcatgaaccacctgcatccagtccttgtctcatgctctgctttcagggaaacccaaactaaaccacacatgagcacagtcttcctttataacacaggctttctagactaacatggctgatgcacattcagtctccaacttaggccctagaacggaaacagggcccagccatccagacacctgtgggaatcctgccacagggcccttggccccactctagggctggtcctacatcctaaacataatcaagaaattctttccagttttcttggctgggtcctttctagcaggaacattttgatggcatgtgacagaaactgaaattgaaccggtttggtcctgtagaagcaggggagattactggaaaaatactgaagcatcacatgaaattgaaggaagggttccccaatccatgggaagggcaggggtgcagctgggcctcaggggaaaagccatattcccggcttcttccacatggaggactgtagccgcaaacagctcaggaggcccatatgaaagaagacacatgcatatgcaaatatcataatgagaaagtgtttctgcaagctccagggaggaagaagctttgtcactattttttcagtgattaactggagtgtctaaaacagtatctgcaatatggtatatgggtaatagacatttgttgaatgaatgaacagtagaaggaggaagagggaaaaagaggaggtgggatgggaagaaggtttggggtatgactgtgaatgaagctatctggccttcagctttggatggaccttgctttttcaagagattatggctgggggcattatcccatcttcctcagctcagaagcttgctgtggctcacagtttcctgtggaaacaacctgacctccttagtgttacatgcaaatccctcgcaagttggcccctacaacctcctcttcacacaccctccactcagagcacactggcccacagcccagggccatcctgagggaactgtcctaagggtcactgtgccctcctctgggacaaacatacatgttttgaaagtggtttttttttttttttttttttttgagatggagtctcgctctgttgccaggctggagtgcagtggtgcaatctcggcccactgcaacatccgcctcccgggttcaagtgattctcctgcctcagcctcctgagtagctgggactacaggtgcatgccaccacacccagctaatttttgtatttttagtagagacggtttcaccatgttggccaggatggtctcgatctcttgacctcgtgatctgccctcctcgacctcccaaagtgctgggattacaggcgtgagccaccgcgcccagcctgaaaaggattttaaattgtttttatgagggaaacatgttatcttgttcatgtaatactctatagcagaacccagtagggaataatagattctgcatatataggaatactcttctaactctggaaagaaaagcataatattatatagattaaaaagaaaagtatttatagcaataaataattgaaatgaaagtattacaggaataaaatattttaaataaaaattaggtgggaaaattgacattgtacttgatgagttgtgaggcctatggcttgtaatttttctgagaaagttagagaagcatgaaatgagtatattcacagtgtttgctgttgttgttgttgctatatatttaccattgtgtttcctcttcagaatgtggcttttcatacataaatacatttgcacagagtaaattttggatgaatttgaaccagggggtagaagatatatcttatattccagcaaagactgtagtgtgtgtgtgtgtgtgtgtgtgtgtgtgtgtgtgtgtctgtttgtaagaccttctgctaaaggatgcttgcagacaaagtccttatcagccatgacacagaaatatggatcaataagtgtgtattgaatggatgaacaagaaaagagaaaagcagcaatttagactgtgtgcctaacactgtgcaaggtgcttagcacatgtcttttcatttaatcctcacaaccaccctgcaaggtgattttcatcatgtctaatttacagaaggagaaactgtggcttgcccaaggtcacaaaactaacaaaggattcaaatccaggaacgtcagatcatgatgcctttgccgtctgcattgagcgccgcagccctaattggttagcttgcgccacctagtggcagaactaaaacaggaaccaggtcagcctgcaacaaatattaaagcagcaggctgcacccttcaacggggcttgtgaaacctggagaagcacaggcacgcctgtgacccacactcactccaaccccacaactgataaaagacaacgcaaggcccagaatcagataacctgggaaagtgtgttgtaaatgaagcatcatttcctcttgaaatacattttttgtcttcctgtactgggaacataaaagtccctcaccatccccttgacctctcagcatttccagggcttccctcgacctcagtctgctgtccccctcccggacccagcacctttttagcactgaggatctaaccttgtgctcatgaggcctggcttggtggcgacacgtcacccagcacacacaggggctgtcccaggaacgaagtggcatgcacatgtggcactccaggcttccagctcatctgtgaacagctgcggtcatttggtggcgaaaactctacagcccacctaccagcctcctagccgcagtcccacctgctccattttcactacagtcgtttttgaagaggggcggtgtttctcctgcagtttactgacaatgtttacagagaagctatcgttcaagctactgttcactgcctccctcccccgctcaaaacacatgaaaagttattctgccctagaaaatataggtgccttagccagcaggcaaataaacatcctcgtggtctatgccctgcttttgtggtctaattcattttctccctcattctctctctcattctctctcttattctctctctcatgctctttctctctcattccttctctcccttcctcgttctctgtatctgtatctctgtctttcataagccgaaacacacatacacaccgtgatataagaacatataaaatcacgtgtaaggatattggaatacaatttaaggtgagtgcaaaaaagggcagagaatgggcagtgcagaaaagctggagttgtcgggggagaagactgctgggccccggatgatgagcccttctctgaacagcatccagtttggacacagtagagaacactgacaatcccaggtcattgtgccttcagttccttagaggaaaaaaagacagcttgaagacaaaatcactgtgagagtcacagaaatgacaatgaggcatctgtttttacttgaaataggtatgcatttttaaatgcctcgcttacctcaggtgggtggtgaattctaacgtactttcatgccagttacttctgcacaccagtgggaggcatccctgagtgctctctgacagctgaacggatcttctcagagatgcccttattccagcactatttctgcaatgtatagaaagcactatccttggaatcagtttcctgcacttgggaatgaggcgatggagactgaggagccccagacgggagccaaacagaaccttggctggggtgggctcctcgtcaatgtgtgtgtggatggggcatggccaggcagggcagaacttcctgaccagctaggagtctgtggaaagcagactggttaataacatggaccattccagctcctatcattatgcatggcacatagcaagaacttaacaaatattgattaaatgaagaggagtagcagacacttacttcacatttttccacatgccaggccttgttctaagtgcttttcttatgctaactcattttgtcctttcaacactccagtgaggccggtgctgttactctccccatttcacagatgggaagaccggacagagagaggctaaaatgcccagaatcaaactagaaaaaggcaaagcaaggatgtacatgagtatgaagcaggtgctgtgctaactgcttacaattgttatttcatttgaccctcatagcaccctgtgaaagaatatcattgtccccattttatagaagaaactgatgctcagagaggttaaaacaattcccactaataagtggcagacttaggatttgaaccaaggacaatctgacttcagacatagccataggggattagcgccccctattgcccactctagtgagttcttaggctgttggggagcagcctggcagtgtccagggttgtcctatatgcctgctggaccctggctgactgggccctgacaaccagcatcctggaactggccagaggtgcagggacaggctggggaggggtgcaaaggccctatctgctcccttccagtcgtctggggcgttctcacattggcaagggcagagtgctcccttcctctgagtggatcagggatgacattgataggcccctggaaaccagaactgctggcttcttctggcctgtgtctcagatgctgacctctggggagtgagagtcggttggaaatccagccctttcctcctctctgagcccatctcctctggaggggtgctttcctcttggcacctttgtgccacatgggaaattcaagtgtcctttggtcctgctggagaaataatcctgccaacaaaaagaccccttcgtaccaacacaggagagagagggcccaatttgtcactgggtaagcattaacagacttgcgtgaaagtgatgccaaagtctggacagaatttcacacaaatttataaagtagaagaaagagcaataaaaacttctctttttatctccttgagtgacaaatggatgggtcttgtgattgtttcctgtgcacctccagagactcctgatttaatttccaaggtgtgtgttagtattctaaggattagaacgtcctagactttgcattataaaatctaaaagtcaagaaggctccctaaagggtgcctcccaccttaaaggaagtagcatcattttatccttactgtgtcttctgaaaaaccaccaatattattccccaaaaacacctctttttaacaaaaatttaatgacatgacccttcccatttctctgtgcatcacttggtggaaatctacagtgagtagagtttaccaaaaacttcatgtttattacctatatttttccactaccctgggaacctccttttattgatgcagaaacaggtgctaaatagttctcctaaaattgatgtgggagagctgaggcttgaacccagatatttgacatccactgtctcttctctactctcaaagaatgtatatatagacattctatagcaagcaaagaaaggtaatagaaaaaaagatgaagttagtagatgcgttatttcttcagtgcgtgagcaccatgccacattctagaatagaactgttcaagagaacttgctgtgaagatagaaatgttatttgagccatccagtagggttacctcaagccacagcacatgtgcgcatgtgtacctgaaatgtggtagtgtgactactaaggcactggcttcttaatttaattttatacattttaatttaaattcagggctgagcacggaggctcacacctataagtgtgccggaggcccagcactttgggaggctgaggcaggaggattgcttgaggccagaggtttgagaccagcctgggcaacatggcaagaccctgtctctataaaatataaaaaattggctggacatggtagcacgtgcctatagttccagctacttgggaggctgaccgcaggagctggaggctgcagtgagctatgactgcaccactgcagtccggcctcggtgacagagaaagaccttgtctcaaaataagtaaataaataaatacataaataaataaatttacatttagaaagccacacatagctagtggctaccatgctgaacagcacaaaagccctgctaggcacatcttgagatgtcactgaggccagtaactgactggctgtttgcttcagaccttggggtgaagatcctgcaaatgtcagctgcccggcactcacatgaagtaggctgccccttgggaaggggaacacatgatcgcagagggtttctggctgcactgccctcctgcaagctggcgtgggcttgggcctgccagcaccagagtcccatgactctagctcccccagaggccctggcgctgtctattcaccaccatcctaggactgctgctgctcgctctgctcctcctcttcctcctccccatcccccagcccagaagggcagcagtcctctcgagtttgccccttcagacaaaccaggacagcttcatccaagtatagaaatagtcacctgctttctcaaagtcacatcagaacagagctgagaggaaccttagaagtcattccttcattcctcctaccgccaccccattttacagttgagaagccaagacctagagaggtgatcagtatcatctttggcctctttgcccagggcagtgacccactgagtccacagatggggcaggaacacgtgtgtgtgcaggaaaaacaggaaccatctggctggggtcaggcattccttctgcctctttatgtccacaggatagttttttaaattgatgatgaggaaggtgcatgtttggcaaagaggacaaagcttccaatcgtttaactgccaaaacatacattggggtcacttattggtgagaaacatttctgtcctgtccttacagattctctgtaacataattctagtttttaaaccctcccttgcacagagattaggccccagttctcataaataaaaaatgcttggagcatatttattgattgcacgacaccgtttatccattttgaagtgagtagtactaaccatcttaacacttttccaagcagaaagttctccttcatggctaacttcactgactttttccccctctaactcagcgtggtatggagagagcttagccaagccagatggacaagtcactgataggccacattctgctaggaatatgtaagctatatatggcagactttgtttaaggtccaaagttcaaggtttcagctatggtcacgcggatcatatcagacttgaagtgagagctgctgtcctgatttgaaacagtctgcataacaaactgttgggcaccactgaaatgtatcagggaactcgctgcaaaaaaaaaaaaacactcaaaatgaatcatcccaaagttctagcaaccaggaaacagacacagtaaggtgagtagtctacgttcccgtgggcattctagctcatttttaatgacatcttatgagtatatggctccatttctctccataattagagttaataaataccttcaagaggatgtttatggcagactttggaatattaactcgttattatcagagttatgttgctgaaggtgaagcctggttttgaatacagaaaccacagccaatgcctcactcacctcaaaatgcaaatgtagcaaaaattaatcccatgggactgttgtctcatgtctggccagaaagatgagaataactaatttgtttgaaagtttcaactgcttccatcttatgccttggaaagtttttcaattattcaaacactaccataaaagaaagacaatggcatttggagtcaaaagtatttgtattgaaatgccaagccagtcatttaatgactgtgatagattaaattacttttcaaaattcttcactccttccctccaccacctccatggaagaattgtatttccctgcccttgactttagctcagccatgtgatcattctggccaatgaaacactggcagatcggatgcaagccatgacttcaaatgtgcatgtgcagtgggacttggcacctgcacctgttccagctggttcactggcccaagaaggaagagaaacgtaagactggacccagacttaatctgcagtttagagccactcagccaaacccaaccaagatcagccaacccccagctgaccaacagacacttaaacaagaataaatgacttttgttttaagttttggggtggcttgtagtgtaacaactcctgattgatacattggcaaagacttagtttcagttactatgaggattatgataccaacttcatagtgtgatctaaacaatgcgatgctatgatccctttactcattgaagaccaataatgtcccactcctgccttgacttccccagtgatgtatgttacaatttagctaaactgggcctacatttcccagtattcccttctctggtggtcctgggttagcactgaccacaagagaatttttctgcaagatatggaagccagaagtaaagcagcagacatgtttttttaggctctgaaggctggagcaggatcccaggaacagtgggtgcttatgcatgttgcaatctgctagcttgccttgttctgggccaagtggttatgcaactctgtggagacgggtgccagcttcccctagaagtcacccacagcattaaggttggaggtagtgagacagatgtaggttccggtttgtattttctcttgttcacaccaagcttccttttacgactaccagtttggccgaccaattactactttaggatcaacatcagatgcagaaataaccgccttcccttgatgcctccactagctcccacgccgtgtaaagtctaatccttataacacatctccattctctctcactcatggttcttcagcttcttgggattgaaccctgatacattgtggctgagtccattgttgtctaaacctgtaaattcaggcaagtacctcacaacatagtcttaagtaatttattatggagcaagaaacacgtaagattaaactattatttattgagcccttactaggtgcaaaatctgtgctaagtgctttacatgcgttatctcatttaatctcataaaatggtccccaatcccctatccagtatgctttactctcatcaccatcatcagttggtggttcggagatacctgctagctacagtaatgctctaagtcctcactgccattaggaattgtacactgggacccaacatcctctggggtggacccggtggcctgtgctgtcctaaagtacacacaggtagtgcccattaagggtttgctttcccctgttcctcattctcaactttggcattaatttttgtccaaagatacaatctttgaccctatcaaacattcagttcccctctaagtatgaagtctggccccaaatatttgcctagtgactgggtcctgataccaaggtcagatctcacatggaaattgccccaagtgtcgatcctcctggactgaagcaatgctggtggccctgtgcacttattgggatctcctactccttactgggcatgtacccccatttgggagctacttcatataccaaatcaagtacctctcacttgccacaactgggactgagatggctatcttccttggaaacagactgctgggcctacctgtgcctctgcaatctacattggtagctaggttagtttcccggcatttgtcctgtctcagcaggtgctgtggcaaagttttccaggttgtacaaagatgaaaattagtagggtttctaattaagatattcaagtggatttgagtggcttttcagtatcagtaactgtggtagttttgtactatattaacttggccaagctgggactatttcccagtattctcttcccaatatggttctgggttacagatgagtaaaaacaagaaattggtgcaaggtttgaaaggcagaaaggaggcagcagctgtgactggagagcgctacagtgtaaggtggtgagagacagctgcagaggcgctggtgggttggctttcatcttccgtctttcctgctgcatgcctggtgcttcttcctgccagctttactgaccaacagcaactccaaccccattaccgatgctcggctgcaagctcagaggtaatctcaccagggaagcaaagacccttccagacttcttcactagccccttccagggtttccactcctgcagctggacattcctaacttccaaatttccccaaagttcgaacttgtccacctgtgccagggcttgaagaggacgtgccttttttccccctaatttgagtggtaaagtctgaagactgaaaaacaactttcctttttaaaatgctaacttgttttcctagaatttgaacaatattcattcatacattacaaagaattgtgtttcgttctgagttctagggctcttctgtaagtgcatctctgcaagtatgtagagaaaggtggagattccccccactctacttccactgtattttaagccttttgtggaattgtgatttctcttttgtgtgtcctttgttttaaactcttagcaaggaataatttgtaaactggtttcccagtcaaatatgtaatcatggcaatttgctaggtaaaaagcagggaatggcaggcatcctcaaatggagttaaagaaatcctaattacttacacctgcagaagctgttgcttttgtaaggtatgtaattagcagccagcgtgtgctggaaaatgtgattgtctgtttaaatacgggatgcagcccggaggccgcccagtttagagctctcccgctgtgtacattagcccagcctgggctctcctggcacttgttaaggctgactgcatgcctaaatgcagtgtgtggccaattgagccccctttccttggtccatgtgcaaagcaggtgtgatcattttaaaaaattggctccttttggctgggtgctgtggctcatgcctgtaatcccagcactttgggaggccgaagctggcgaatcatgaggtcaggagatcgagaccatcctggctcacacggtgaaaccctgtctctactaaaaaatataaaaaattagccaggcatggtggcgggcgcctgtagtcccagctactcaggaggctgaggcaggagaatggcatgaacctggcaggcggagcttgcagtggagatcgcgccactgcacaccagcctgggtgacacagcgagactccgtctaaaaaaaaaaatggttccttttaacttagtgattatgaactttctgcttttctagcccagtggttctaggccttggctacatgttagaatcgctagggagactttttaaaaaatcctgatgcccaagttgcacccaaatcaattaagtcagactcactggggcatcaaatttttaaagcgcccgaagcgattacaaatgtgctgtcaagtttgaaaaccagtggttcccaaacttttaactgcatgcgaatcagcaagcaggcttgttaaaacacaggttgctgggccctacccctagattcaataagagggaggcaagggtgtccaaaactttgcacttctcatatttatgccaagaatactgtcaatgtttgctgtggcttggatatggtttgtccacaccaaactcatattgaggcttggtccccaacgtaatggtgttgaaagatggtgagacttttaagaggtatttggataacaagggatctgcccttgaagaaattaatgacatctggtgggagtgagtgttccctctcccaagactggattagttaccaagagaggcggttgctataaaataaggctgactctccagtatggtatctttgcacatgcccgcttcccgttctgcttctccatcatgttaggacacagcacgagaccctcaccatggtcataacatgaactccccaggcgccagactcatgagccaaattaacctttattcttgataaattatccagtctcaggtattgttacagcagcagaacatggactaggagaaagcgcaaaacaatgtttaattcctttcggagttagaatagttaaccattttttgcacatgacaggcattagctgtcatgttttatagatactagctcatttaatcattttcacaaggctgtttccttctcatccttcaggtcttagaaaaagtgccagagctcagactcccttaaaaagtcacctgacccagttactctctcccacatcacctggtttgtttccttgggggctctaactcatctgtaatcttgcttctgtctcttctagttccactaagtttccaaatgtagaaaccgaatcttcttcccctagtgcctagcatgtgacaggtacttctttgcctagtgcatagcacatgacagctatttttctaattgcagaatgaatgggttcacacagcaaccctgtcaaagaggtactatgatccagatttcacaaaccagaatataattattaagtaacttctcggagatcacagtggaggaactaagattcaaattgtcttctgaccagagctgggctctgaaaccactccaagaattgatcatcagccttaaacaatcagttttctttccttgtaataaactgagttactcatctaagaatgtcaactttgtcttactaccacttgactcagttatttttttcccaaacaatagaaatccagagcccaaactgtagaaattggcaatttccttatttaaaaactactgtccataacaaaaagtctattaacaataccccaaagcagttaagatttctacctcatataaaatcataaacattttaattcaaaatgttgacatttagaagaaaaactacataaaagcaaatggatttgaattatctgactttatttagcatgcaatgcaatttattctggcaataaattaatatgtgcagttataaaaaatgttgggtactttttccaagaaaaatgtttctgaatgtgcacactagaatatatgcagaatcctttaaacagtcgacttcatattttaaacttgtaagtgtggtaacatcaagttttggaagaatggactttttctgtaattcatgatttagtttgagtttataaaggttttaattgcaatttcagttcctacaagctaccaagcctgaaattagagaactgacagctgagaaaggcaatcacctgatcgagtctcctaattgtacagctgaagaatccaatggccttgccaaagattacgaagctaaaaagagacatagcctggattacaagtcagtttttataggtgctccaggaatgtcttgagctaaataaggcacacgtatcacacagaactttagtcgtatctcagagtccagttttactctgctttctctttattttttaggcatgaggtcttgccctgtcacacaggctggaacgcagtggtgtgatcacagctcaccacagcctcaaactcctgggcccaagcaatttgctcaaggccccacaccttgctaattaaaagaagattttttagagacagggtctttctatgttgcccaggctagtcttgaactcctggcctcacatgatcctcctgccttagcttcctgagtagctgggattacaggcacgagccactgcgcctggctctggttttaccttctgcttaacacaggattcaatcttgatgtgttctcctacagttcacaaacttagtgactcaattgctttagaaacaaagcaataaatgatttgatttagaaataatttggtttagaaacaaaaccattcccattattgcagcattatcatcagtcactgactgctaatgctttttatgcttcttttttcctgggatgtgtgaacctggcaacttttcttcctgttcttctatgttcttagcaaacccacatcaagggtgtctgttcgtgtttgaaactcatcagcatcagaaagagctaacatgttggcagtatctagaaaaccatcaacatgatcatgggacagttcattttgctttgcagctgatgccaccatagtgagtgagtactctgctctgttcatctgagcagtcactttgcttttgcaaagcagttgtggattacttctgggatgtcagtgtcccaaatggcaatgagatttctcatcacatccagaatatgccacataatgtactgagcattttcagctcggtacattataatttttggtaatttattgtctcagcctagtggctgcacacagccatgctgctggcaggtaaaaaaggctactcacttgttttaacgtccaatgaatgtgtgcagtacatttaccagtaacagaacatttacattctagcaagctatttttctaattgcagaagccattcctaaaacaacctgacggacatcactgcattaataaatattttttatttatacacagtaaagttgtgtatataaagggaattttcaaatttccaatgtaaatgattctaatttcttgctatgcttagtactgcagcaaaagaagggtgatagcctatctttatatatttctttttctccagggcaacatttctctgcaggagtgaatgtctggtttggctgcatgttatagaggcttattaaatatgctctcatgggcatatttattcacaataggtctctcattttcaagctcattctccgctgtagatgctttaccttgtagtagtgacacaacactgtgatatgccaaaagcacagctaccagccatggaaatttgacgttaacccctacctggaatgcaatttcattagccttatcaaaacacaaacaaaaactcagatacagaaatattacttgctctgacctggcaaagtcattcaaacattccacttactacactggtatgctttgctcctctcattctgtcaccaatttcacttcttttggatgtttttcttttcatcttgtcctgacttccaaggaatatgcagaatataagaaaagtcctcattctttcatcacttcattttggactttctttcttgttcactaacttttagctctggagacattgtgacctcactgtattttctctttaatactatgaccaaactctctgcatgaagcattacagaaatgacacgctgaacagaacatgtccattctaatgggaaaactgaggagactggcttggtatagaaactggaagtgtggtactgatgaagcaactaattttaaatttagaacagcaaagctgatgtcatatttcaaaggaagggctaattttaataatcttaataaccaagtcaaaaatacaatctcttttttattaagaaatcctaatgactgaggtagatgatgctgttgtcagataccgaagtaatttggtttaagatatgaaaatgatgaaaccaagggaaagaaagcactgttttgaaattatcttcttttaaatttagatgcataattaagaatgcttccaatttaaggttctaagcacaaaatccagatatgtcatgttatggacttgcttcctgaagatgatatcagcagttgatagaaagaatccacactcttacagaacagcaaatcataaatggttgtctctgtgaagccagtagctttgcattcgatatttctatctgggctcattccaaatgttcaggatttggattcctgaaggcttcttcagcatttaactaattctttgttggctgaaggggctgggactgtttctccacacacaaactgatcctaagacagagtgagaaatgacattaaccaatgaatttccggtcacaaatacattaatattaaaccttcattttgttacagcatcaatccagcgctgttaattgtttttcatttgctattatcatttcatccttgttcaaagagccaatgacagcaccagaagtagaatcttaaacatgtatcagttttttgatctgaattcattatttaatacaaagcaccttataaacaaacatccctatcttcagttcagagcaaccacttctcagaaatcacataaagacatgccacatattttaaatttctgtattaattactacttacactaaaacttctccactttaatatttggtcattcaaataccagtcctcttcaaagtaattacttcttctaactaaaagggacaggtctttatgtggttcccaacatggataatctgctatgttagctactttgtaaatgaagttcaatctctggtcttttatcctggcttatgtcagctaccaccaaaaatctctgcttccaaggttatccctcacctccagcaatctgattcccgaaggatcagcccctactctgtccctgctactctgttgcccaatatgtggaaccctttcactgtgccctttggaattcatggtccattgttagcacaatgcttcatattctcaacctctttctcaaaatgtccttttatccccaagagcactggtaatatctggaaacagtttgaattgaaacaactgaggattgctattggcatctagtaggtagaggccagggatcctgctagacatcctataatgcacggggtatctctgaacaacaaagaattatcaggcctaaaatgtcaacagggctgaggttgagatgaagtcatattcttaaggacagtttcccctacaagcccatctagtggaggctctgtgttctcagagtcctagtaccagagggattggaagtggggctagttcctcctttttgcctccattctcctttcctgtctaaaacccatcagtttagaatcttatgtcttgagactaccgccttgctattcttctctgttgctgtcatttatccaccctggatgccatattccaacccctctggacctccaccatattcatcctaccaccctttcactgcccctcactcccttcatgttctctttacctagttcaaactccatggtcagttataaccactcttctctcactccttactattcacttgggaaaaccttaaacctggttaaatctaactttccatgtctatattcactaatgaaggctgaatttctaccaccttaaaccctctcttgatcctctatcaccactggttactgtcccatgtctgtgctctcctttgcagcaaactccttaaaagaaatgcctatactcactgccttctgttctctcattctctccaaccagtattctgcccattggtttcttcactcatgcgctgttcctgttactccatggaaactgctctcatctccgtcacagatgaactcagtgttgctaaagctaatggttaattcttgattgcttcctatcagtgtcacgtgacaaggatcaccacttcctcaatcctttctcatctggtttccaggatttgacactgctgattttcctcctttctcagtggtttctcctttaccatcagctttggtgattcctcgcttccctccctgactttttaatactgtagtgccttaaggctcagtcctgtattttatccatctctacattcacagacctggtggtctcatccaatctcatggctctaaatgctatctgttactgataactcccaaattgacattgctagccaatctctctcatgaacgccagacatgcatatccaattgccttctcaacagctcaacttggatgacagacctctcacttagtatgtacaatttcaacccctatacctatagttacattccctcaattgacagtaactccatcctcccagttattaaggtcacaaatattgaaatcatccttgtctcactccttcacaccctatatccaatcagttattcaaagcgtatccagaatctaagtacttctcattatttccattgctgtaaccaggtccaagccacccatctccttctttaattagtgtaatagcctcctattacactggttttcctgtttctatgcttgctctctataggctactctgaacacagcagccagaatcattttttaaaaaacttaagttggatcatagcactcctatgttcaaaaatcccccaatggttccctatatcactcacaacaagagcctaagtccttaaagtgatccacaacttcttacgctactctcatcctgctctgctctggtcacactggcctcctttttgttccttgataaaatcaggcatgttcctgtcttaggtccccttcactgaacgatcctttgctcgactctcttacctcataccctcatatgtacatggctcactccctcacctccttcaaatctttacctattaaggcctttctcagtaaggcctgccatgatcaccctatggaaaactgcaacttcctcccagaccagcactcctgatcttccttaccgtttgctttctgttgcagagcacattttaatacaagaatgaatcattatatttctaaattatagtctaaattatagcccgcttctctcatgaggctctgtgcctcatccccactttccctatattcattttggacttcatccttgagagtgttaaggtccttacctaagattccattccaagtactgaacaaaactttgggtaggagtgggcagtaataacattttttttttctattgtcaacatccttgggtgaaagataatagggcaactaaagactaaaatgaaattgtaaagctgcacctaggaattatatctcaaacaagataatgcagaattctgtgtataagccagcacgaaataccatacaattgttcccttcaaagtaagtctagcagctctaaacaattttaattacatattaaatagaagagaaatataaaaaattgtccactaaaataatctatatactttctatttaataaataataattttcactaaagctagatttatctctaaagctaaaataaattacgtaatctgaactttaaacgttttaatttactattcggctgtttatcaatggtgtttaaaacctgcctaaaaaaataccgcactttacctagcacaatgaaacattctcctgcactcatcactgacaagctgatctaagtccttgccactgacttacaatacccttcccccgttttaaaattatatcccttactttgtcataaatcacttttataatgagagagcagctaggacacgttgccacgtcttccccattctccaaatcttcctacaacgaaatcaaataccatgtggtcaggatagcttctcttcgccatctcctcccccaaacctatcccacccctagatgcaagtctcttggtggcttgccttccccccaaggtgggtgagaaccccagggccttcagcgagaaatgccgacatcattttcccctagaagcgtcacttaggggaaacacctaggaaggtcaggcgagcttcggtcgccccaaaagccctgggaaacaaaaaacgagtcccctcctcgacagaaatatcccaggttgggaccctaaggcagggatcgggcagagagacagaggctctccgccaccctctccctgacctaatctaaggccagaactgcgtgcctaccgagagagctcagggcattagttggggtggggggacgcgggaggaggaagattcagcaacgggaaagagggcgtgggtgacacagcgcagcaaaggctacccaatgatggaaggaacgggcggaaccaaactgcgcttgcttgggtgaaccgccgggcgggaccctgaagttaccttggtgatggagaagttatctccacatgggcagggatagaaatacgtctccgagtcctcgtcatattggaagtcctcgatttccacctcgtcatgaaacactgccatggtcagcgggggtggccgaaggggtaacgccccagcagtccgaggccagctccgagggtttaacttcgccggaaccggcctgggctcggcatcatcaggtcgcgccgggcaaggactagcccttccggcgcataggcaatgacgcaactccgccctgcgcggccaaatggataaccggtagcggtcaccatggagatggctgaactaggggcggagacactgggaagactgaaagcttgctcagcggggtcgcgcaccgctcctcctattgggcggcagcgaccaatagaatgtggggctcgcccgcgctgctacgtcacgtctgggaccgcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggtacattccgcttcttcctcaccccagacgccttaaaataccctaaattgtgttgctgaaaggaccaagccctggaaggcagggattgagttctagtcttctgtttgccaggcttataacattattaacgacgatgatttttagtaatagtaataacatcaccttttattattgggaagttatgtgccagctattgcactaagtggaattgtcaactctaggagtttacatgttattccattttattaatctttaaactgaggtacagagagttgggcatcttgactaaaatcatacacctgggaaataatgaagagcttgtctgtctccaaagcccaggaacaaattacttatgtgagtaccagttttttcgttgtgaaagaaatggtgtcagtaggcaggtttatcagtgtgaggcctatgtatgccttgaagcgaaatgcagataaaaggcatttttgtcttgaaagcagtgctagtgcctgttttggtaaaaccgattacattgggtcttacttaattactaggcattttaatatcttagtagagaagaaatgcattgtagtgaaaaagcactttcgagagaagatctgggatcggaatcttgagttgttgattacctctggcaactggatatttacattctttgggccttatttcctcttctaagaaaggattggagtagagatgatataagatcctttttagatgtaatgttccacttttgcacggaaattatgagctttacttggttcagcaatgatatataacatttagtttacatttacgtaacacatatacataatatatccctgtgcacttttgaagaaaacattacaatgactactaaactttacatttattcctaaaagggcggatcacgaggtcaggaatacgagaccagcctgaccaacatgatgaagccccgtctttactaaaaaatacacaaattagccaggtgtggtggtgtgcctgtaatcccagccactcaggaggctgaggcaggagaatctcttgaacctggaaggcagagattgcagtgagctgagatcacgccactgcactccagcctgggcgacagagctagacgctgtctcaaaaaaaaaaaaaaaaaaaaaaaagaagtaggtcataattgtataatgcaaactatatttgatgagtgctgttgtatatcaggccagaaggagttgtttattggcaataccaaacctccacctctctaggttgtttgacaaggaagagaaggggtcaatgtattaggattgattttagtaacactgttgcttgccaggtactttggtagacattttatttattcctctcagtaatccagtgaggtggcgtgggtaatgttaaaatggcaagaggagacttgctgaagattagaaagcaggaaggagtcacacctgagcccagttccgctgatttccggtcaaatactctgtgtatactacttgtttaccactaaggtgtctttgcctgttggagcaagaggagccctttttcttcctcagtgacacctaagattctaaattgacagatgtcatgattgttctttgaacttacttaatttcagtgcatttatgcttattgaggcattcttggcttttctctgtcagtgtcctctcacaccctgcctaatgtatcagcaagttttggggctctaattccaaaatatatgtcatgttcatctacttctgccatctctgtagctgttaccttattataatcttagaccagagtcttttaactgggtttcctgcttccactcctgcccctctccctctgttatccttcccacagcaacttgagcagtcctttaaaaatataaattaggtcttgtccttctcctgattgattcagacttttcagttgcttcccattacccttaggataaaattcttacccttactatagactgctggacttcatctcatttcactcttaccagcttactgctctccagtcacactggccttggttcctttaacatgccgggcttatttctgtgttggacctttgctcttgctagtccttctgccagagttgtctgcctttaacatttgcttggccgccttttcctcatcattcagatctcagccaaggtgtcatcactggagagatgtctttcttgatatttcccccacctaccccatcactcttactccctttatcatactcatcataatctataattatcttgttatttgtttactactatctgtctctggaactgtaataaaagcttcatgatggcaagggccttgcgtctggttctttattatatctccaaggcctaaaatagtgcctggcacccctgtagttgttgaatgaactgagtatacctgttgaactgaaaccatataattaatcttaaatgttaaatttaatctgttgctttcagaagtttgttttactacatatttaatgggtgtcagttttatttagcacttattatacttttctgcatttcagaaataaagttaattaagattttttggtaagggaaggcctgtgaggatacagacattgatgggatggtctactttatatggttttagaaataacttgatatatattgatctgctgtggttgattaaatgcttacagtatggaaccgccggacatatttcaaaaaattagtaggttttaaattttttatattttatttaaaggactggcataaagctttggaaagcactttaaacagaattttataaaaatgtcctttatttaccagtaggtggcactcttggtcatggttactttcacaaaataaaatcttaggattttaaagagaactcctttttttttttttttttttttttttttttttttgagactgagtttcgctcttgttgcccaggctggagtgtaatggcatgatcttggcccactgcaacctccgcctcccaggttcaagcgattctcttgcctcagcctccttagtaactgggattataggcgcccgacaccacacctagctaattttttgtatttttagtagagatggggtttcaccatgttgaccaggctggtctcaaactcctgacctcaggcgatctacccacctcatcctcccaaagtgctgggattacagatatgagccactgtgcccgggaagaactacttttaaaattaacatttgttttccagttcagttgagaaggggaccattcaaacagcataatcattaaatgatgtatcctattgtgaggacaacttattttagcaatagttgtctaaaacattgaacagaacagtatttccatatttaacaatatagtggttaaattttatcagggaacttggccttaaatgacatgtaactgtgtcattctagcctttggtctgctgtttcctggggtggatatcctaagtagcaggtgttaaagacaggcaaggaagatgaacaaaataagctgtaagataaataatcaaaaaagaaaaatggaagcatggaggaaagaatggatggagagggggtaattgagagtgggcttgttgtgaggtgatgcctactgattttaatgagcctttcctttggcagctaagaggtaatagtgcttttgatcagttccccaaaacattgttatatgttgtttgtgccattgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaaggtaagtttcaacttctttctttcagggattaaggtaacattattgacttagaacatttaatggagaaaaactacgtttagtggtcttgaatgaggttgaagaggccttctgcttttttcatttagtaaagagaaaaatagcaagtagcatgcttatccgcaatgatgctgcaacatactatgacaagaagaaatatatcgtttatctaaagactagttatgaagcagtgagctttttaatatgatttgggtataaccaaataaactgcatatgacttatatcaccatcagatttatttatttttatttattttctgtcttcatctattggaatgcaagctctctaagagagtttttgttttcttcatgcctaaagcaccattgcttaggccagtgcctgccacatagtggactcttgatagatactcgttgaatgaaggaccaaattaatgaatatggagtaggaatgtaaacacttagcttgaatattttgctaacagcaatttatcacaattaatttatatactgcctcccaaaaagctcagaaaaaaaagtattcacatgcattttcatttattctcaaggtaactaagatggacaaatagagcaatgtaacatgttaaatgtggccattttagacaaagaaatgtttaaaaattgacataggaaaatgatggaaaaggaaccaaaaagaaatatcatctgactcctaatcagtgcttttcttgacaggctggtagtttttagaatttgaaatgttgaagaatctgtgtgtgtgtttaactttttgttgaagttcaagtacaaacagaaaactacacagatcctaagaggacagcttaatcagtttttacaaaaagtgaaaatacccatgcaatccgcacccagattaagaagcaacattgtcactaccacctcccaagggaaattgctaacttgatttctgacatcatggattcattttctctgtttttatactttatatgattagaataaaagaatatctgttctttggggtctggcttctttcattcagtatgttatttgtggtaattcatctgtgttactgcatgtagttgcagtttgttttcattgctgtgtagtatatcttactgtgtgaatgtatcacagttaccttatctcctgtagtaatggcatttggatagtttccagtttgggctattaggaatagtgttattattttctgttttggttttttaatatctggaaaccttaagcttcttgtttgggaaccgttgtaaatttatcttcctcttacacttaacaagaaatataaaagacttatgcagtactcttcaggtagaatacaattatcaggaagttataaaatctcccctcttctataatagcataagattagtcatgtgaacttggccagagattttagaaagtgatagagaacatgaatatttgataataccaaaaattacatacttatatacataattgtggagataccttgagtcaactctaaatagtggcagaaattttgtcaaggtgaagttaggctcttggctgctttggtggtaacttgactcataatagcaccaacagaaatccacactcttcctcactgaccctctaaaatagtctgatatttccccacttttaaaaaaacaatttgaaatttcagttttctgtttgcccagaaagcgccatggcctgtgctgctgttatgattcctgggttgttgcggtgctctgttggagccatccgtattgaggctgcgtcactgagattgacactcagcactttgcgccaccttactctaaccaggtgagtcattaagacttctgtgtcatttgaagttaattttcaaagagacccgacctgctgatggttgtgggaggcatatcaaactcccggaaaggtaacaccttagcttcaatgtgcatgctgtcaggttgttaaccgttttttttgtctgagatggagtcttgctccgtcgcctgggctggagtgcagtggcacgatcttagctcactgcaacctccacctcctggattcaagtgattctcctgtcttagcctcccgagtagctgggattacaggcgtgcaccaccacacctagctaatttttgtatttttggtagagaaaggctttctccatgttggccaggctggtctcgtactcctgacgtcagatgatctgcctgcctcggcctcccaaagtgctgagattacaggcatgagccaccatgcccggccaaaactttagttagacgggcagatactcactggccattttataggatctgtaatgttacactgtatttaggataaccatgatatttcaggaaaaactaattttattatttttatgaggataatatgtaataacctaattttactttctattaaagcataatgaaatccaaaaggaaaactgatcacatggagagaactgcaagtgtccttcgacgggaggtttgtatctttggggtatgacaggtttttccagctagaccgtttacatgtggttatgactggcttatgggtaaagcattagatgagtctggtccttttgaaggagagttgggaagtttgttatttttctatttagaaattttctgagcaggacatttgatatctgatttgaaaagatgacagatactcaaatttttccctttaaacttggaatgaatggattaccttttgatgaagcaagtagagcagcaactgagggagccatcctcacaggtatgatgtttagggttatgttttagcactagaacttcctttaaagcctacattttatgaatagcttacctttctctgtttttttgtgtggggtcttttttttttttttgcgtcacatctcaaagttcttgttctcattcctgctttagagcaacttatttcatcaagggagaaagcactaacatctgagaaaggaaagtggacgagctcttgttacccttctaatgtacagattttttccaccatattcagactatagaaagctaatctaccacctgaaggggtgtcaagggctgagaaataaaggatcctcaccctttacctcagtgagtaaccccatttttgtttaaaaacataaatcggatatttgattttgcttttttgaatgtttatcacttactcagatatatttagcttagtgttataagtatatgtaagctaacaataaaaaaactatttcatgtaaagaaggattatatacttctacaaacatgggcagaaattatattgtctcatttaaatttatctattaatagaaggatacactttaatgtaaaggcatattgtttaggccctacttttaaggctaacttctttcagaaagttactttgggactaagggtaatgtgtttgttgattcagcttaaagttcttttttttttttttttttttgagaagtctgtaaaattagtttagcatagtagatttaggagcttgtggggaagtacactttttccaataataaatctgaaaatactttttttttggtttgttcaagtgaccaaaaatgctgattctgtaaatgtgagacttgttaggatttctttttataaaatgaaggccttgcaaattatgaaaaaaaaaagtgatttatcttacaggctctttcctgttgtattttgaggctggtagaattagagcagaggttgaaaatctttccctagaaggccagatagtaaatactttagattttttgggccgtgctgtcttaattacaacttctaatctttgattttataatgtgaaaagagccatagacagtatgtatacaaatttcatttaccaaacacccagatttggcctgcaggtaataatttgctagtccctgaattagagtattcatttcagaattttattttacaagaccaattaattttaatagcctgcagaaactaagtgaaatataagcaaaaaagaatcatcaagcatttacaaacaattagtatattatttactgtttagcgtcaactgatatttactgagcacctcctgttttccaggaccaaaaacttgtttcttaccttacagaattctcaaaactatgccgtaagatacataataatattttaagacaggtaagatagatagatagttaatagtattttcttgttttttttttttttttttgagacagagtcttgctctgtcacccaggctggagtgcagtgggtacaggggtacagtcatggctcacagcagcttctgtctcccaagctcgactgatcctcctgcctaagcctcctgattagcgaggactacaggcacactattgtgctcagctaatttttaattttttgtaaagatggtcttgctgtgttgcccaggctggtcttgaactcctggcctcaagtgatcccttctctttggcctcccaaagtgctgggattacaggcatgagccaccacacctggccagtattttctttttaacagatgaaaagactaagaatcggactaataggaacttgcacagcatccatcataggcattaacatacttaattatgttgactgccaattctaaggaaacatatctatttctcacatttttattgttaccacaaagtcttttacatttttcaaatttgtgtggatataaacagtatttttatttatatcaccatcatttctgtttcctaataaaagacctttatctccctaaggttatcaccacttatctataatttcttgcttattaattttaataaaatatacataagtgggaatgtacagtattcagtattctgtggtttacaaatgaggcaggcacatactttaaaggttacacctattaagaaatagatgctaatggcacgtctctctctgagtacgctcacactcccttttgttgggtgtgtgctttcccccttccaataaatcactgtactatcactaaaaaaaaaaaaaaaaacaaaagatatcaactatgatttctaaaatatacttaaatatatttaaaattaacctcattaaaatttttggtttataaatataactataactacagtatgttaagcttaaatgactatgtattatgatggttagtgacatataaagtactgatatacatattctttcaagtttgaagtacctcacctgagaactcggctaaggggcagttccttagtttggttccactggaataaaattataaaaggtgtattttcctttatgtaacagatacataactatagccaaaaggtcaggcaacacagaattcagtaaatactgaggataatgcaatagttaatgtcaaattctagccaacttctagtattatgaaagtatgtctaatcttagggaaaacctgttctaacaaaattatcttaagaaaaagggaaagaactataaagaaacagactattagagatctagtaaatattttatagattagggactgagcttcagtcttgataagtaacttgcccaagccatatatgccagtggtgaaaccaggactgattgctgaacctgacgtctgtttcaggttcttttgaacatgcccttgttctttcatgttatgaccgaatcgtaccatttattcaccgaattttaactttaatttggaaaattatcaactaataaaactttttctcttcagcacaactctctagtttttctaaaaatgagcattttaagaacaggatacagttgataacattagagcactctcatagttccttaagatcagaactttatacaggaaaaagttccctttacataaagtttgatttggctggagaaagcttataaaacagtcatagctttaaagcctttttactctgtatcatagtgacatcccctgttgtaaaacagttttttatcatctgacattttcttcagatagccagttttcctgctttggctgtcttataagaacttccaaagacttcagtctacctatagtttgttgtttgtaggtcaggaagagttatcttagaatgtagcttacagactttctgccaaaaatgttctttagttgtgtcttgtctgcagtaagaatgttcaatttgtggtcaagcgcagtggctcgtgtctgtaatcccagcactttgggaggctgaaacaggaggatcacttgagaccaggagtttaagaccagcttgggcaacatagcaagacccagtctctgcaaaaagttaaaattagctggacatggcggtgtgcttgtagtcctggctactcaggaggctgaggcaggaggatcacttgaacccaggagttcaaggttactaacgtaagctattatggtgccactgcactccagcctgtgtggcagagcaagaccctgtctctttaaaaaagaaaagaaaagaaaagaatcttccatagtttacatccttatgtaaggagtcttcaatgtctatgtcttccatttccctggtttctttttgggcagatataaaagaattaactacgggtttagaaaaatggcaataatagattatttatttgtgtttaattcttcaactgtttgattaattgtgctaaataagaatgaattatcctgtgctgacctgattttcatggaatatttgtaaaatttggattagcaagatgattggtagttatttcaagcacttcttgggtttccaaagactgttgaataccttctgaatttgaaattatcaaagtaatagttgtaaaatttagatactcaaaagatgtgtgaaaagcacctatatccatattttagttaactgatgtttccaacgtagattctggtttcctagttaatcttgtttaactagtttaagagttaacatgtattttgacttgaacctgggaggcagaggttgcagtgagccaagattgcgctactgcactctagcctgggcaacagagtaagactctgtctcaaaaagaaaagagttaacaagtattttgtatacttcttggttttagaagccagtggcttcaccaaggcagatgaatcaagtaattgcgtgttcagggagcacatctgtgttaactatatttttctttgcctcatttaatacaagtgatttttctgatttggcttttaggcatacttttttctcatcttccaattgtttcttctgtgaattttttttttttttaagaaggatcttttacttgattgtcttcaggcagaggaaaaagttgttggaactgtactttgttttaaatatcaaatcccccgtctgatgtcaagagagtcaggagtgaaatggtcactacatagtaactggtatttactagaaacccatcaatcttgctattttttttttttttttttaccacttttcaagtgtttctttgtcatttagaggaaatgggtaaaaactcagcttctggtctttgttttttttgttcctggcgatttgtagagtaaatcgctgtcctgtatagctgagtttcacttgtatgaggtcctgggagacccggggccagcaaaaggtgcaaggcggcccttcttccatttcagaattttataggacaaaattattgggacttttgggggttattttgagccaaatttaggtaaactacaaagaaagttaatgcaaactcttgagaattttagtgcccacaagtcagaaaattacaggaaaatccaatcatggtactacctttcaggaaatttttagttgcatctcttctcctcttctgtttctttttctttctttctttttttttttttttgagacagagtctctttcttgttgcacaggctaaaagcgcaatggtgcgatcttggctcactgcaacctctgcctcccgggttcaagtgactctcctgcctcagcctccccagtagctgggattacaggcgcctgccaccatgcccggctaacttttttttgtatttttagtagagacggggtttcactgtgttggccaggcttgtcttgaactcctgacctcatgatctgccctcctcggcctcccaaagtgctgggattacaggcatgagccacagctcctggccctcctcttctgtttctaatttcccctcttctcccatacagaatgagaactgcgaagagttgggaggaactggagaaagctagatggtatctggctttctcagcagtatatggtcattaggaacttgccccaatctccagagggtgctcctagccatagagtaggggctggaccctggactcgttgaaatgaatggcacctcaggtttggccataacagaactggatcagcttcttatagtctcgtcttccattcttgcctttaatttgtatagtgagtatactttacacatgttatttgctcttcagttcaagtccatgaggtagcctaaggatacgatgccatctggattttacaaagaggaagcagggcctaggacatgtctctcagtgacgaaaggaagctccagctcagaattcctagctaaaggactgtgttgctactcttggagtcgacaggaaatggaatactcacccagaaatgttcttttggttttgggcatgtatttcctctggaaagtttactgaatgaccatttatgatgtttatgcttcttacttgggactgtaactgtaagtagtctgagattgtgctgatggaggaaactgaactctgaattgaattacattggaatgtttgtgttcaagttttattcattttattcttaagaatcaaaagaataagcagtctgagtaaccctagaaatgtcaaggagataaagatagaaatactgtaatgcagtaaagattgttcaggcaagacaaattttactggagggggtcattccgtgcttggcctctacagactgttggcctactgagcaatatatgctctgttcatcagtttgttgggagagtttggcagtgaaagaatttcttaaattactaattcatatgcattcatttgttcatttggaaatgtgccagaccctgggccagatcctggggttacagcattgaaaatgatagataagctcctatcctcagattttaatgggactctgatcagaagactttatgcacctaattgattttggaaatctttctaattctttttctattgtactagtttgcttttagaagcctgtgtcttttcctacagtatcttatgtgtatgttgcctttttgtttacaaagcaccagattatacaacagattggtacttgattctcacaaccattctgggagggacatgtagggattttaatttctatttcacagatgaggggattaagaatcaaagatttaggtaggatgaccctgcttcctcatttgcctgaaatagtcctggtttatgcctctcgttcctggtgtaatagcactcactttcactctcaaaattattctgtcttgaatgataaattatattgttgtcctaagtttaaaggacttgttcaagggacaaggactcagtccttgaactcagatctttgataataaaatcagctttcctttatgttacagcagaatatgacactctgtttagacggacaaggcttaattgagcaatgtgttactaggcatgagaaacgggggagatactgatggcagagtggttagttaataaatggctgggcccctggggcagatgcctttggggatcctacagttccaggtgctgattttccaatgcttataatccgcttgtgatcttgatgaggcttgggtttgaatgggatggtctgcttagctgcagagtggactatgtcccaaggctaacttttacaattctctactggtcatcacctatgcatgtcaaggagattgtggtagagtggtcacttcaatttgaggtagggggcatcttttcaacatgcactgtttctcaacagttattcctgtaacttgctttggttattagagcttgatggtcaaagaaccttttagagatgatccagcctgggatgagcagtgcttgacgctcctggcttcacactgtcagcagtgacaaagcagagcaggtggagagaaacctcaggcactcactgcctggaggtagttgtaggggatctggggggctggactgcagctcttagaaaaactcccaaggaagtatagtctgatggccctggcagctggcctctggcccctaggggtgtgtaactaactcttctgtgagttgaaggctacaaagaaagggaggctccttggggaaaggcccagtttagcagctctgtaatcatagtatctagcacagtgccggagaaaaaaagagttccctgttggctgtgttaaatttgaaatggaaattaaacaggctgttggacatgtgagatgagagtttaactgctagagatgaaaagttgaggccacgtagagagtaagggaagaggactcaggactcagcccaggaatgtgtcaacagttagaggccaagcagaagagcaagagccagcaaaggagatggagaaggagtggccagccagataggaaggagatcagcagagtgttcttggagccagggggaaaagtatttcaagaaagagagaggagccaactgtgctgaattctgctgagaggtcatcactggatttaccaaagtggatagtgggtgaccagaatgactggctttagtacattactgagggtgaaagcctgatcagattgtgttgaggagagaatgggagatgagaaagtggagacaggaccatatgtaactcttgaaatgttgtaatatgaatgggagcagagaaatggggtgaaagctggattaaaggagaagcttgttttgtttgttgtattttgaaaagcagcaaagaccacaagtgcctggttttaaatctgctttgccccttactggctctgggacctcagttttctcatatgtaaaatggggatataataatattggctttctagagttgtgaagactgagtgaatcaatgtatgtaaagtgcctgacatatggtaaggatgtctataagtgtttgctgctgttgttgttgttacatgttacatgaggtgggagatcctagagctcgtgtgttctgatggggagggtagagagggtgtgatgcaggagagaggatagttgctggagggaaggcttgagaagacggagaggagaccagcccaggtggacaggttagcctttggtaggagtaaagtgagtttacttgtcattctagggcatagtgttaaccagcataagccatttaagaagttaaattgtgtggttgacggagaattttgtgtctacctttgttagtaaatcacttgagtaaaatctgcttctagtcagattcctacacatcagattgatactctgctaccatttaaataatgtctctgggtctcggtgtctttgtgtgtaaaatggcatatgattcttgataatgactaaagtttccttcaattctgaaattctctgaaccatacctacatttttgttttaggtcatctctagtcatggctttgcctaaatttttaagccagaaaatgaatgaacaggagtgaacagggaaagctagccaggtttccaaagaaatacctatttcctgtacagagacttttgcaccagcggtaacatcaaaatatcctacataaaaccagctttttaaacaagtgtgatggaatttccttttagatgctgactctgcctcagcattaaacatgtgtactggtaaagttggcaaatgtgttgttattttactgaacactggaaaagcataaatgttgttttatggaaaacttcatttcctgccatgtgttttaacttaggacatggatagttgaggtttcagttgtgaatctttcgatccattaagtataagagccaatacaaatgataaaataaatagtttctccactatgttttgcctatccaacaaaagaatagcatataacaggggccacaattacaggtcctaattatatgaactagcttttggagtaaaataaatatgtggtcttcaaaaagatttcgttgatgtttttaatccacattgctagaaatctatatagtatacagcatttgtgttaagcaaaataaaatagtaacagggaagcatgtctttaaaaataatgaattgtgcagggtattttatgttccagatatagataaaacaattttgtccagtttgttaggataaatagcagtaggtacattactgtttgtatttcaggttgagtatctctaatgcaaaaatctgaaatctgaaatgctccaaaatccaaaacgttttgagtactgacgtgacactcaaaggaaatgctcattggagccttttggatttcagattttcacatgagagatgttcaacctataagtataatgcaaatattccaaaattgaaaaaaaattgaaatcctaaacacttccggtccaagcatttcaggtaagggatactcagcctgtcataccaataattggtcatagacagcatccaaatgaaaatatggcttaatagaaagtatagcttgtttccttcctcattgaattttacatttggacattggaaaatgactaatgcttccatttcacatagcctagcacttgatcgtgacgcattctcaggtgtctcagctgaaattcttttccctatctagttttgttaaggaattcaacacatgccagttaagctgtcagaaatgaaataatctacctcgaggctgtattttaacagattattatatcgaaagaaaaaaatgaatgtttataaaataacatttctttttttttttttttttttttgagacagggtctcacttggctcactgcagtcttgacctccaggctcaagtgatcctcccacctcagccttccgagtagctgggactacaagtgtgccaccatgcctagctaatgtttgtaattttttttttttttttttttttttgtagagatgtggggttttgccacgttgcccaggctggtctcaaactcctgggctcaagctatctgcctgccttggtctcccaaaatacttctgtaaatgtaagaaaaggggaataatgaagtaatagagacctctgatgattctcattacttgtctttgtaataagatacttaaaaaagaatgtgtggcaaacaaaggaaaataccagttctactaaataaatgtctgctctccctgaactctcccatacttttaaacatgaatctggattttctgtagtgttctcttcccctatccacccagcttaaaaaaaaaaaaaaagtgctcctgcatttctaccaatctttgttctgaaaaaccattttaagtgacttaaagttcaagtttttattcattctgcaaatacttactgagccttactgtgtgttgggccctgtgcttcatctagggagttgacttatacatgctgaatatggtcagaaaggcaaaaacattatattggtagagttgagagtatgaagagaagagggaggacctcaggcagggggtgttacttgagcagggcctagaagggtgagcagaaggttggtagaactgagagagcttggcacatgctgaatgacctaggtagggttttggggaagggcaggtgttaggtacctttgaggaccagcaggttgtccagtttggccaaaaaaccacaagcacagtgatccaggaggagtcccaagttcgtatgagttaaacgggactttcagctttttttttttttttttttttttcggtgattgagtagtagagagccgtttaaggtttttaagctggagagtaactcagtgaggttggaacattaggaatatttgcctgttggctgctttgagagacacaagaaggagaccaaggtagtagttcaagtgagaagaaagaaattctcagcttagggtgatggcaagtaggcaagggaaagaaaaaacatgagccaaatttatggaatttggctgtgttagggacagtataccagaaagagtcaaagtttatgtgtgtttgaatatcaactgaaaatgtaattgactgtgttgagtccaagatgcatccataattgaatatctggtaatggaaataagctgattttgcaaggctctgtgagggcaggtgcagtcttctctatctctgcataccctgttccccagtttcaggcaccatgctcaataagtgttcgtggaaggaatgactttggtggatttcgttgtatggcataagtgcgtttaccactggagcagaaccatcagatgatttagggagggtcaagctaacctggatttgaatccgcaattcctagctaggtgatcttgagcaagttactgaatctttcagtttcctcatctgcaagatgtaggataacaacactgtctcttgggatataatatgattattcatatcaactgaatgaatgaatgcacataaaatatttaacctagcatctggtatatacctgggataaatgctcctcaggcattggctgctgttacttatggggagtgttgatgtcagtttgtgattggcagaaaagtaatgatgagttgtcagcagaaggtgggaggagagtagtagtctgtgagtccttgagggcctcaacctggagtggtagaggcagtaggagcaaggcagtttagggaaagctcctacagaagaagtgagagaaggaatggtaaaggagaaagactaggtcagtgataacaggaggggacctgagaagttcaatatggctgttccagacaaggagaatgcatcagtgtggaaaataccaaattcagagaggtcagggagggtgagaactgagactggacattgagtttggttgttcagaaagaccccaaccgtcaaaggagaagttgcaagaacaccgaagctaggttacctgtggttaaggtgagcatcaaggaaaaagggaagattctgtgggctatagaagagctgattgtctcagtagaggaagagacgaaaggcaagatttctaaaatatattcaagacagtatggcttttacgtttgcactggtaaaaacatgtacaagcccaccacactgcagtttcttgttgtccatgtgagcagtctctgagatgttcagtgctcagtctttaaggccctggtgcaaaagcattggtatggtggcatatatagttataaatgaataaaatgtaatatataatgtaaacaaatgctaattaattttaattaagacaatgaaatacagtcatgtgttgcctgctgacggggatgttttgataaatgtgtcattagctgattgtcattgtgcagacatagagtgtacttaaacaaacctggaggggatagcctactacacacttaggctaaatggtatagcctattgttcctagaggacaaacctatatgcatgttactgtactgaatatttcaggcgtttgtaacacaatatttgtgtgtctaaacatagaaaaatagtaaaaatctggtattatgggatcaccttgtatatgtgctttgtcgttgaccaaaatgtcgttgcacagcacatgactgtacattataaccaacattaatgagttctgtgggccagcagcattgtaagtacttttgtcagtattatctcatttaatcctcccagcaaccctatgaggtataggtggtattattctcattttatagctgaggagggctaggtaacttgcccagagtcacacagctggtaagcggtagagccaggactaaataccaggcagtccagctgcagagcccatgctgttaacagccatattctgctgcttactttattttgttgctgaattgctttgaattgcaaatggcattagatgtaatctttgatgaaacaggaatgtactaaagggaggaaaattgaacatgaaggaaagggctggtggttgctgatggagcagtgtttctgagagagtaggcaggactaggaccaagagtgcaggtagagggtcagtaatggaaaattaccccagttgatttttaggagaggagcaagagagggttgacaaaaatatggagaaagaaaggttaggtattttgcaggagggagagaaaggtagataatactagaagatactttgaggtggtgagagagaccaccatccatcatgagaattatccagtggatttttgaaaatggtctccactaatagtttgatgagatttagtagtcctattggagtagagggcctgcatgagctagcattaggatgggacgttcattgaccttgacagatttccaaagcaccctttggtggagctgtgaaggtcacactttccaaggagagggctatattttggttagttgctgatttgctgccacaagtaaagatgaacagacatagaaggttgaggaaggaaagagtcatgttgtcttttttctttgcttgtgaagatgtcccaggcttacaggacaaagaaacacaaagcagatgaaagaataaaggaaatagataccttttgaatttgaggggtgttgagccatgaatggcacatacctgcatagctcccgagtcaaacctattcaaggctttccagaaatcagatacatcatgtaaaaatagtgcttctcaaattatctgtagggaagggctctttttattgttaagattgtgatctgtttccattttataaaatatcgtgtgataaaaaatgaatttgaaaattaattaaaaacaaagacatgaagaatgcaaacccattttgttttctgttactagactcaataggcacaagattgttctgtgaaattgttaaaagtttctaagtgcctgcttttgatttctgaaattagctctttgtgggctccttacacccccagaagcaagagtgggcctcactttgcccagtgctgatggagaatttaacggcagctccttgataagaccctggcttgtttacagagttccaattccctgagctcttcccagagtgcctagcccagtgcacagcacattgtggatactcatcagataaatgccggttaaaagatcccttgaatagatgatttttgaatgtaggataaaattaaattagtatgatagcaagtctctcaaaaaaaagttaattaaaatgtattcacatggtggtaggctgaactaaagcaaagtgtgttttaccttgtttggcaattttcaaaaaccacatctttgtaggtttcaaaaaccttagttctcaggatgccaccatttgtcccttgtgctgtgtacgcactaacctcagccacagttcatcttttggttttagattgtgtcagcagctaaggtgtgtggagctgccagtgagtcaccgtcagtgaagagcctccgcttgcttgttgctgatcaagacttttcctttaaagctggccagtggtaagtgacttttctgtgttccatgtatgtatgttcaagaaggtgccatcagatagaaggtattattttttctcctggaaaaggctagccattcccttgaggaagaggaattctaaatcatatctgctcagggtgagcctttgttggcacagaggatctgattccttttctggcctcagagcccacttgggttttgagcccgtggctccctcagtcgtatatgaaaattgctgtcttgtgttttccacattcaaacaaagctagttctggcccatggaactgacagctctgataattagactcttcaggaatggttgctaacagaatgcacttcagtaatctaatctccttgagttacgtgttgcaggagattcataggttttttaaaagtagtcttcttcgtgtccaatgcagagtaaacaaagtatcctgaagagaagaggaactagtgatgtcatcacagggctcactaccctcttgactgaatttgtctatcatatgtaccttatttgggttgaatttaaatactttgcctaatttgttatcaggattccccagtcaggcccagctccccagaacccccacacaaatcataagtctgtcccatttgactcgggactgatcagcatgctgactgggtaacatttcctccgaatggggcctccctgagcttcaattcaagttcaattgtaaggaaagcaacttgaatttccctaggaaaggtgtgtttgggtgtgtgtgtcctttattttaataaagcattcatttctaaatggatttctggcatgtcagtcttgatagtgtttcttaggagtcacttgactaattttggcagtccatctggaaatgtggttttgttagaaggaggatgtgtgataatagcaagtgtgataatagcaagagttagcagtcttgtgtgttaatagtttgcctttgaatttagaactagaaaacaagatgctgattgcaataatttgggtttgtgaagcaatttactgcaatctttgcacatgttcgatgatacacattaaatgcattttgcctgttttagggggcgggcaacatatttacccttcaaaaatggtttagcagtcattatattgaaaagtggaaactttaattgtaatgatctgttttccatatttcctttctgtggaaatgtttgtgtcctgtgcaaagcactgtctccgtgccttcaactctgaatcctgccaagactcagacccagcctcctggttaggaaaagcctgtgcattggttattgtgctgccaccgtggtgtgcctgcaagtgtaatgcacttgctaacctcagttacctgataagaaaatgtcctcattccctagtgatatttgtagaaatagagtcctactgtgattctcaagatgaaatgatttgggattggtgtcatgtataccatcccaatgaatggatttggccatttcactgaatttaggcctggttttcgtatgtgcctgtcagacttcttcggaggtcggacttggcgggtaaggatcactggctggtagtgtgtgacgctttccctcccaggtgttgatcagcattcattccaggcccctgggccctcctctttcaacaaattttacccttaccattgatttatggttctaggggttgtgagttccttttgatatttgaccttatggtcacagaatggccattttgctgaggttggcggtgtctgtcccttccatgctgttgcttgaatggctttgtgctctaggctgtctcagaccatcagcttggtagtaacagccatgtggtactttggagaagagggcaaggattagggataggaagtgaggatgtggctgccatgcagtttgtgtaggtaggattatcagactggagagctgctagaaatcaaggagagggttgctgttgggcttatctttggggtaagagattgggccgtgattccacatctctgaatttttgaccagtggcttcctctgacacctaccaaactctgagaatgaggttccaggcacaactctaactaaataaatgaatgttgtctgtgactagctggagctttggccacagatccccatgtagacaccttcagcatagatcagatataggcctcaaggggctctttttgcactacactgtattcttactgggccttgcagagagggctggttcctgtagcaataaaccagttccaagaactgtagcaatccaatcccgagagaaaggccaaaggcagaaccacctcaaaacatctctcacatgagcagggttgaacttcttggttcatcttactagtaggcctaccacttgctagctccttggtgaggcctgcccttgaccagaattcctcctcccttggggtggaaagcttggcactcactcttgggtctggagcatgccaccactggtcctcacacagtgtgcagctgccctgagtttctagattcacatttggctgtggtgctcactgcctgcctctggcattggttatgctactgtgggtagcagtgtattgtcgcctagtgccctggagactgctcagctcacatgcttgctttctaccagccagctctgtgatgtggtcagtttccttatttgtctgggcttcagttctcatatcttcaaagagggagcagtagtattcctacgttttgggatatttaaagtgtttagcataatgcctactgttaacttcatttgtttgattttagcttttgttattgctaataagtatttcattcagttagatcatatgtgctgataaggcccaggggacagattccaattcttatctccttggtcagtttccctgcactgaagctgttgattggaagagtggcaggccaggcaggagtgggggcttatcaccaccatgtcaccactgatgccccagtcagtactcaatccacacttggctgggtatagcttgcctcctgaggggaagtaaggccaaagcattttcacagagtggagggaattcctggtcctagtgtgtctgactttctacaagataacataagtttagatgctagaaagcaactttgagccctgctgagagaaagaggacaccaagaagaaacactggaggagcaagattagagaaataagactttatacctacccttgagcagggctgccacactgtagatagataatatccttgcaacctacacaagcatgtgtggcagccctgattctcacaggactgcacataacatagcactgtattccttggcatctttttcaaactgtgtcctcccccattactcatctggtaagcattgtgtgtcttttaagactgtttaaagggcatctcttctgtgaagtctttcttaattcctgtactcctggtagaattgactcctccttcctctgccttgcctcgctacgctaagcagattttatcattgcccatttaattgtatgtatttgttaattttcctcctcttagagtgggttcattgagggcagcaactaagacatatgtgcatctttgtacctccagcaagtaccacagtgcctgtatatggtaggcaggtgctctcttagatgtttgcattaagtgaatgagtgaggggctctgagaactgtaggcaaggactaaagagttctgggatctcatagtatagctgctgtgtgcttggcactggggctccctttgtggacaggacctggctgcctggtgtgtcatggttggatgtggacatccactgcttcaccgcgcacctaggctccttctgcatacactcactcattgggtatatagtaagggctttaactcatggctccaagagtgctcatcctgcaaaggacatttttaaaggtgtgtgtttaaggtataattctttcttggacagatgttttatgaaatatgtattgtgcatattttcttaaatccattcagatgaagtttttatgtaacttaaattcttctgtattttttaatgaaggagtcctttttttccaaaggtagctttccagagttactagagaagagggttggttccctttcattcaactgagagaatggccttcatcagcattgagcagcagagggcactgtagttcaggagatgaagcagcaaaagtagcttattaatgtatttattttttaaacatggaaataatggagatttttgtatacctcctctgtgatagcatatagcaactgtgttaacaaatgctaacgatagtcttttaaatttttatcttgtcagaaatgaaaagaaagttaaagtactcatggaaaagagtcaagtgaaaataggttaaagttggccaaagaccttttctggagcacttccaatccagaactggtttttaaacacttataataaatgactggaaatgtaaggccatagactgcaggagaatatttttttaaggtcatagatcagattagagaacatcttttgcttttcttttaggcctgtatgtaggtaagcaactggggaaggatgatactttttgctcttgtgatggctgtgaaacacctagattggatgtttatgtttcccagatatggggatgagaattttttgtggttctgtgttccaatacatttttcttggtatgtgactaggtttattgcatttcctagaatcctcaccaaaaaagggtttctgtggcatagaattattgaaagcttgaaacccaggagttctagactacaggatgtggttagaagaaaagaaggaaacgttaagacttgtgtaactcagaggccatatcggcctattaagtctgtcaaatactagtgggagagtttttgttgcttttcttgacccttttttcatactttttaaaacttaaaaagactgttatgttgagatatattcatataaaattcaaacatttaaagtgtacaattcagaggttttagtatattaacagagttgtgcagctatcagcacaatcacatttagaacatttttatcccagaaagaaactctgtaatgattcttattcattccctatcctcctgcccggcttagatgaccactaatctattttgtctctatggatttgtctcttatagacattttataccagcagaatcatacaatacagtgtgtggtctttttgtgattggcttctttcacttaacatgatttcagggttcatctatgttgtagcctgtatcagtacttcattccattgtatggatatgccacattttgtttatatcttcattagctgatggacatttacattgtttccactttggggctattgtgaataatgctgccatgaacattcatgtacaagtttttgagtgaacatacagtttcacctgtcttaggtctaaacctaggcatggaattgttgggtcatatgctaactaactaacattttcaggcactattaaattgttttctagagtggctgtgccattttacattcccaccagcaatgtataaatgttccaatttctccagaccctaacactattgtttgtctctttgattatagccatccacgtgggtgtgaactgccagctcattatgattttgacttacattgccctaatgactattgatgttgaacatctcttcatgtgcttattagccatttatatgtcttctttgaagaaatattaatttaaagtattttgtcagttttttatttggttgtctctttattactgagttgtaagagttctttatataatctgaatacaagaaccttaatattaatagatatattatttaaaaatatttttcccattatgtagattgtcttcttaactttttttttttttttttgaaatggagtctcactctgtcgcccaggctggagcgcagtggcacgatctcgattcagtgctacctctgctcctgggttcgagtgattctcctacctcagcctcccaagtagctgggactacaggtgcatctgccaccatgcccagctaatttttttatttttagtagatacggggttttaccatgttggccaagctggtctcgaactcctgacctcaggtgatccacccacctcggcctcccaaagtgctgggatttgtataggcatgagccactgtgcctggccctgactttcttgatgataacatttgtagcacagagttttaaattttgatgaaatctgtttctctattttttttccaacccttttggtttggggtcatatctaagaagccattgccatgaagtcttactcctgtgttttattctaagagtttataattttagctcttacatttaagtttctgctctgttttgacttaatttttgtatatgttgtgaaataggggtccaaattcattctttgtatgtggttattcagttctcccagtgccactgttgagtagactgttcttttgccattaaattgctttggcagccttgtctaaaatcaattcaccatgaatttaaggctttatttctggacattccgttcttttccattgatctacatgtctgtccttatgtcagtacaacagcattttcattactgtagctttgtagtaacttttgaaatcaggacctgtgagtcctacaaatgtaaacttctttttcaagattgttttgatgattatgggttcctcaaatttccatatgaattttatgatcaacttgtcaatttctacaatgaaaacacctggggttttagtaagtattgcattgaatctgtggatcaatttgaggagtattgccatcttagcaatatttaagtctgccatgccatgaacatggaatatgcttccatttacttagatctttaatttttttccaatggtgttttgtagtttttactgtgtaagtcttacacttattttgttaaatttattcccaattattttattcttttttatgctattataagtgtaattggttttctaaatttcacatttggattgttcgttgctagtgtatagagatacagttgatttttgtctgttgatcttgtatcctgcaaacttatttgaatttattagttctaatatctttttagtgaatacattagtattttctatatatgacagcataccatctgcagcttccacctctgcaatctgaatgccttttatttcattttcttgtttacttactttggctagaacctctaggacagtgttgagttggagtggtaaaagtagacatccttatcttgtttctcttaggggggaaactttcagcctttcaccattaagtaggatgttagttgttctgatcacgttttatttcattttcttgtttactcactttggctagaacctctagtacaatgttgagttggagtggtgaaagtagacatcctaatcttgtttctcttaggggggaaactttcagcatttcaccattaagtaggatgttagctatgggtcttttgtaggtgccctttatcaggttgagaaagttcccaattattcctaatttgttgagtatttttgttatgaaaaagtgttggattttgtcaaatgtcttttcttgactattgagatgatcatgtgggttttgtcatttattctactgagtggtgtattacatttatttattttcagatgttaaaccaaccttgtattcctggaatttttgtacctaaattcagaagggatactggtctatagttttctttcaatgtctttgtctggctttggtatgagggtaatactggcctcataaaatgagtcgagaagtgttctcttctgtttttggaatagattttgaaggatttgtattaatttttaaatgtctgatagaacttaacaggatgccatctggacctgagcctttcttttttttttttttcttgacatgaagtttcgctcttgttgcccaggctggagtgcagtggcgcaatcttggctcactgcaacatccacctcccaggttcaggtgattcttctgcctcagcttcccaagtagctgggattacaggcatgcgtccctacgcctggctaatattttgtattttttttttagtagagacggggtttcaccctgttggtcaggttggtctcaaactcctgacctcaggggatccacctgctttggcctcccaaagtgctgggattacaggcgtgagccactgcgactggcctgggcctgagcttttctttgtgggaagttttaaaattattaactcaatcctttaacttgttatgggtctgctcagattttctttcttcttgagtcagatttggtagtttatgtcattttaggaatgtgtgcatttcatgtaagttagctaattttttggcatatagttgttcatggaattcctttataattctttttatttctataagctttgtgatgatatctcctcttttattcttgattttagtaattttttttcatagtcttgcaaaggtttgtcaattctgtttaatttaccaatttttaaaattgcttcaacaataatcatttatttggctttctttttagggttgatttctttattccaggagtctctgtggttggtgggttttcaatatgctccagtcccagactgctagaacaagagagagtgatagaattggcagtgaaatatacgaaccaccctcctgccctctgggttcacaatacggtaagcacactgcctgtttaaacgcgatgatctgggtatctctgccacccacaaaatttgtgttaagctcatttgattcacctaagaaacctgggcttgagtaaaagggtacatgcccagaaagagcttctaagaaaggtcaaagaaactttgatgcattaagtatgagtcagagactttgggatctggaagtattttctgggtcaccaaacggtattcagttgaatactgctttagaattaaaatattttatattttagacaagttctaaaaagttggctctctgtgtcatgtaaatggtaaatctataaatcagattattttgtcctaaccatcctaaataaagggaattaaattattattctgtcatttttggaggggaaactatctgattacatagtactgcttcttcccagaggtgagcacagctaaatccacggtgccattgcctctctatttcagtgtctggaaagctcttcactcgggattctgagagagaatccaatttgattgctgttaataactcttatttcaccacagggctcaacacaatcctacagaagctgcctgtcattacctactagaactctgataacaaagaatgagctcagaacagatcagttactcgttgtcttagtttttgacccttctatccttttcacttattgctttttctattcttttccttttcctttcacttcctcttcattgcaagagtgtcttctatatttaccaacaacctccatcccaaccaggcattttcttaccttctttaccaaaaacacataccagtataaatatggcttcaaaaacagcattttcctgtttcctggaaatcattgaaaatcaatgaaggaaaaagaaaacaaaacctctattttcagcaaaacttggaaacacactgtagtatatttttaaaggttgcagagaatttttgggtttctgtaggagccacatggaaataagtagaggagagaggccgagtagcaaatttcatagagcaccaacaaaaatacatgagggagtggggtgggacttacagctcttgcctgcaaagagggtatggaaacacagttgcgttttgtggctgtagaaggcccacctgaacgcagcaaggttcagttaggagagaaggcacgcaaagaatcacacaggcaaatcatgtttgtaggaactaatatgtcctgtagtagctgaagagagcttttatgttgtgaaaaccagctagcttaggatactctctggcccatcccccaatgtaggaccctcttgcaaatagtccaaaaaaaagcacagttcatttcaatcccatgaaagaaatcaaagaagacatgagtaaatagagagatgtactgtgttcatagattggaaaactcaacatagtaaagaagtcagttctccttaaattgatttacagatttaacataacaataatcaaaatctcaacaggattttttatagatatggacaaagtgattttaaaatttatatggaacaaaaaaggacctaggatagctaaaacaattttgaaaaagaagaataaagtgagaagaatcaccttaatcaaatttaagataaagctacagcattcaaaacagtatggtattggtgaaaggagagaaacacatcaaataatgttacagaatgaagagttcagaaatagactgacatatatggtcactttatttttgacaaaggtggtagattcaatggaaaaattgaaaggcaaaaggataaacttttcaacaaaagttctggaacaattttgcatctagatgcaaaaaacaaaaaaacgaaaaaccaaaaaccttcaacctaaacctaaacctcatactttatattcagaattaactcaaaacggattgtagatctaaatgtaaaacatggtactataaaagttctagaagaaaatgggatatttggaacttgagggtaggtaaaattcttaaacacaataccaaaagcaagatccatcaaaaaaaaggttgatgataggacatggtcaaaagtaaaactttttctacaaaaggcatttaacacaatttaaaaacaagctacagactaggagaaaatatttacaaatcagatatctaacaaagggcttgaatctagaatatataaagaaatctcaaaagtcaacaaaaagaaacaagcaacatgatttttttaaatggacaaaggattgaacagacacttcagtaaaaaaggatatgatgatggcaaataagcaatgaaaggtattgaaacatcgttaaccctgagggaaatgtaaattaaaaccatatgtggtgggatgccactacgatctagtctaatgtctaaaattaaaaatattgacaataccaagcgttggcaaggatgtggagcaactggaactctcatatattgcttatattgctagtgggaatgcaaaatagtacagccgatctggaaagcattttagcagttttctataaagttaaacatacacctaacatatgacccagcaataccacttctgagtgtcttagagaaatgaaggctatgtttatataaaagcataacatgaatatttatagcagttctattcataattattaaaaacttctagaaacaacccaaatgtccctcagcaggtgaatggataacttgtgatatagtcatacaagggactattaaagagatgaattattgatgcatgcagcaatgtgggtgaatctcagaggcattctgttgagtgcaaggaggcagtcccaaaaggttacatactgtaaaatcccatttttgtcacattctggaagacaaagatataatgatgggaaaccagtggttgactggggttgagattactgtaaaggtaggatcgatagcacaggggaatattttcagggggtgatggaactaatatatgttttgattttgatgattgttacccagatctatatgtgtgttaaaattcatagaaccgtataccaaaagaaaaagatttctattaaggaaatttttaaaataagtttttaaaaatgtgcaggagcaacataatatattcttgtggtttacacgtcaagttgtgtctgtccaggataacccccagatgcctgtgtaggcatttccattgtaaatgtatcctgtcacatttttaccctgcaaccttctgagtctctccgtcagtgtggcctcagctgcctcattgctttttggagtctctggattttcccctcattactggctctaggttgctcctagaggtgctaaaatatgctgctggggtgagagcaacgaggtatctgcatgccccttgctcagagttgaaataagcatagccatcccagttcctagtgccatgaacatctccccatcctccctgttatccttagcttctcacgcgacctggcctggtcctggtccacagcttcctgcttggtttcatgcctcattggcatttcagtgaagaaacttattcttacaggctgtagaaaatctcaaagtgttattgcctgaatgcacatcctaattgtagtgcctgctctactctgcccagtgggagttgcaaacagcctttatgaagtcagatttttcttggaatcattttcaggtggctattttcctcctgaggatttgtcttattaagccattcgagtggacaatggaggcacgtgagtgtctgggtggcagcaggctgcaccgttgagacatggaataaagtgccataaacgtcttcctttattttatctgctttggctcaagctcttggcagggtaaagggttctagacagctattgtgtgctcagctccagttgctgtggaaaggttgtttatttcacaagtagaaaatctataccaaaattagatacattgctgtgtaattgaaggtaatgtccttttattcacttacatattacagtgtacagtactttgagtcttgtgttcgtgttaccctcgcagtttttattgatcaacaaaaagacaaagatggcttttaattcttcccggatgctaccaaatcagaatacagacctaccgaagattattttgtcgtcaaggataagacaggcttcttgaatattatctttccctggggcacattttcttgccaactttagagttgaaaatactctggtttctaaaaacaataacctagaggctttctttgttgtcattactaagcatgccaaagatggccactggagaaaattatttcagtctctttcactctgattcttatagataaagagagaactgcacaggcaagcaagagagggagggaaggaggatataggagatgaaattcattgtcatcgttaggcagagcctcttgtatcttaaattctatttttgagacttgaaaggaaagaatattttaaagcactttggtagccactgtagcagttcctagattttagttattcctaactgaatgctcccttgctgctaatttcttttgtcaaaaatgaaaacccacttatcaccattcatgtaaaaatctcccacatatttaaaatagtgaggttcagacattttttcccctgaaagagtatccattcatttaacagttctttaccaaaaaagacatgtttttgtgaattcaaataattttcatttttcttagatcttctctaaatttaactcaactttaacttgcagagaccaaattaaattcatgtccagaagtacctactgctcacctgacatgcaaggtgccaaggtgtgaatgctaagggtttggttctcaaaaagcacgcgatgtgttattacttcttaggagggcattcatttagttgatttatgccaggaacgtgtaatgggagaaacctatgctcttaatacaagtttctttattcctagaatctgttttttagtgacagggaagaaggaagctggtattgccagcactttttcttttgtgacagctgcaatgaccaaaattccttcttatgtagagccagatactcgggagttccacccactgtgagtcagttcatgttcacaccaaccctgtgaggtgggcagtgcaggtgctggtacccattttccaggggtggcagatgaggctcagaatttaagggacttgctggatttcataggggctatgattaaaattcagtcttttgactcctagatcagtggtttttttccaaacaagggattaccaactcggtcagatccaatgctcctttctagaactgtcctgaaatgaaagtcatagttaatgtaatgtacccataggtttttttttaaataacataattctctaactaatacaaaggagaaataaaagaaagtgatccataatcaaagagtatgtattttaaaatataaatggttaggcagatctaactggaagatagaatgaagtaatcagatggctattcctaaacatagaatcaccgtgaatacactgtctacaaatgcagatgataaagatgtgttgtgtgggtgacacatgtcactaagtggaatgtggttttccagaacagtgaacatgcttggttaagttctgaacacaacaaagtgtaatctacactgtggctactgagtttatttgtaaaatgagctagagtctagtctcagatcattataaaccagttttcacctacaagaacgtcttttgggccattcacaagtcattgtgcaggacagtcttgtgcattgtagataatggtgtgctggcaaaccagctgtctgaatttatctgagttgtatcatttgctgatttctgtgctgtaagtactcctacaatggctgatttcaaactaccagtaggaactttctcacaaaattcctgtagatttgaccaccagcttagtaggagccagctctgggaaaccacgaattttgtaggatctctagcatctctggccctgccctttaaatgccagttggattccccaaatcattgtgacaataaaaaatgtcatcacaagtttcccaaacaccttcatcagaagcagtagcacccccactgagaaaaacagtacattcaactctgatggtattacgggcataagtgacctcaccaaataggtgctttatctagataggtctatgtgatactccctagtatgaagcctctggctgcctgttcttgtttctctagggagacaggaacagcactgaacagtactacagggctggtctaagcctgtagagctggtctggctgtgccttactgaggatcaagaaggagcaccagtacttacacttttcagccttgatgaacccagggcaggcagtctagtgacatttgccacatcctgtttctctcagctttggttagaacacaggaacacaactcagataaaggagacccatacttcagagctgtaccctgcctttgagtccattgcctctttcctcaatccagttcatcgcctaagaagttaacaaatggtgaaatcactgaagcacatctccttttctcagtattggaatggctgttcattatggattacgaaggtggattagcctgtggcctataaaatgagcaagtggaatcaattcacagggcatcgggaaaattgggagcaagctataaaaatagtcttaaatactgataatacaggagatagacccagttttattaaagtagaacatttggtttaagacctttgctacaaaagactaaaaggtcttttctttcctgccttagtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaaggtaagggaggtatagcttgctgtaagcaaacttgtgtagtggtattaattgttcatgaaagttttttctctaggttttgttttctctgcaaaggttcaaacaaaaggcttggcaagatttaatcatgcttaaatgagaactaaccaacacaccttacccaagacaagtaaaactgctagtgttgaagaggctagcagttaggtgacaggaaagggtaggttttggtgggatggaatctggaggttaaatgaacagaaaagtcacaagggtcccgagattccagtcaagagacctacagtggactagtgtatcacaggagtaggtaagacttagacagtttggacccagctgggtaaatgaaacccctgtcagttgcatctgtttaaactaagtgcatttgatgaagaaagctttcactggggattgctttgcagctgcaggaatgaacaaaagaacagaaacagttaaaagacacaactgtggtcagtgaaactgctgcttaattgccaatgcttgagaaaaaggaaaaagaaaaaactcccggagagttggtaatatgcttgttagcatattcagatttcaattaaagccaaatagccctctgtagtctgaatgctctggcctgctaggctgcaaacaatatctctctaagtagagagcgagagcggcagacgtgtgcagaatgggagttgaggttcagcgtcaatggttgtgcacatctgttttgattttttaaaattgtagtgtgaccaaatatgtttgacattccagaaaaatatccttgatttagtaaatgaatttcctgagaagattgcatgcagtttgcatgttacaaaacagactacacaaatcaatgcggaactcaagccatacatcacgggtgagtcccctaaagatattttgactatctccatgcagttatttgatggacacaccagttggttgagcgtagatgctttattgttggaagctgctggctgggaatgtcactatctggggaattgggatgattcctcatggaaaaatggatatttagttgggtttactcattatatacaggtttcctattgcctgtgttaaaagtgtacttttcacactttttaagaggcctttgcatcatcactgtagtgtccatacaaataatttatattccagatttggctgaattgattccatttgccattaatggtcatttaaacaactcataatttcctctgaaaggatttttataaaacagttacttcctttgctgaaggcaatttgtatctccatcaaagaccagtaagctagctggccctttctgcagagtgcattacgatgagcttcccactttgcttgcttaggtttaggaagcctggagatgcactctgcttgggtctgggcccagatgccaataggagccatactgtgaatggcttaagaagactagactcactgaacttggaaataaacactgtatctgaattgtggttagtccttcctcatttgctgatacaaccatgtctggcttaatttggtgtttattctggtttttggtagaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataatttaaatacaatcttaataattttactttgaaaattctttttatttaatgcctttgtttactgtaccatggcctacagtcttatttggtccatcaaagttaagtttggacatggaaaattgttaggaaaactgctttagggagttaaatatccagcatatttgctttcttgttaatgaatatcctaagtgtgtatcctgactaattgttagtttcttctcaaatgaaaccctttctgtgtcttggctgtctgccttaacgctgtaggaggcagcttcttgcttgggacaaaggcattggtgatgtgttccatgttgaatctgccttcagtgcctgggctggcttgctatggaaatgtgcttagcattgattagggggtagagagctgtttctaaatcctgcttttctactttttatttcactcatttgccagaattgttcttggcaccagcagctccttaacatatagttgttgaatgactgaaagaaagcaactaatgttttaactccttgctaagtctgagattgggaggcagtcccctagagtggatagaaagaatggtggagcctcatcccaaagctgctctgatgaaactgctagaaagcagattgtagttctttgtttagatttttaaaaatccaaaagaagtcctgactgaggccaggccattccttttatgacaagtagtcctgggcccaaggttgcctgcatagagatcacaggagggtgaagggagcctgggaagaaggacagataagtgctggagacctaggagctccagttgagattctgttctggagcggatgagagaagacaggttaccctttcttatctttgttgttgcaggcctcccagggacttgtgggcttgaacagatatgattcatgggacctgaaggtgactctagcttctgcccagttttgagttttgtcaagttttaagcagagatcatttgtcaactattttgatcccagatttgaatttggggaggaagggaggagctactgacctgatgggaatatcataatccattcaaggaaatggtcattagtacctcagaggtgaagggaatatgtgaagctctggatcactacaaggagccctgacttaccagttggccccaaagtgcccaggctgagggcataggagcatgatgagatgcaaggatgtgggattatcaaggggcacgtctactaactggtgaaggcagtctgcgggggaggacacctaaaggtatgcggaaagtacctaacccagacctctctgcattaggagtggaggtgcaaagtgagcatctccagtgcagcatgggatgggaagatagggaggtgtcgcccactgtctcggtttagccagcaccacggctggctgtgtgcctgctactgtcagagagcaagggtcatctgtcctgcccagctatgcctgccaccctgttgctgactcagtattggcagaattgctgagatgggccaggtcatcacctttgcctggagtgttcatcctttcagtgccattattctggtgctaagtgctgaagaacattttcaggtctagccgagaatgtcctcttgctcttgcctgccaggcctgtccagatctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaaggatcctctggctctatgagtttgaaaaaatgtttcttcttttgacataagaccctttcccagcctactcaagggactaggttagtctgatatttgtatctttctcagattttatttatattttttcaaacatatgacaaagtagagatagtaaaatgacttctcgtgcatccatcacccggcttccatgactagcagcattctgtttttgtcagccctcagcttctttgtgggggtgttcttcttgctggtgtgttttcaagcaaagcctagcaattgtatcgtgtcacttctaaattcttcagtatatatttctaacagatacatcacctcagcacaaccacaatgtcatcatcatacctaacacaagtgacaatgattccttaatatcctctaagacccttctgtgttgtttcctcatggcctcaaaagtccgaatattgcattaggttaatgtcttttattttaattaattaatggcacactccttacaccccctacacatatacatggacactttttttcccccatgattcatttgttaaagaaactgacttatttgttctgtaggctttcccacattttgaacctggcctattgtatcctcagggtgttgcttgatcctctctcctctgtatttcatgtaaactggtaattagatttagaacttgtttatattcggattcaagattttttttttgcaagcctgtattataaagtggtgtgcttcctgtggcatcacatgaggcatataatgtctgtcccacttttaatgctgttaagatggatcagtggtttcagcatttgtcagcctgattcatccaatataatggtcttcatcaaactttcacctaattgttttagcagccattgatcattgctgatagctattttttcattaaggattaattatccatttctgttattcttcctgtatatattgtctgtgattgttccatatagaactttccctcatcagctttgattcccctgaaatgagtctgtaaagaaatggcagtattgatgcttgatttctttcatttatcagttagcatactatgagttggtgccttagcaacctttagacgaccagtgagattatttaaagtatcattatgaactcatggctttttatacatttgattgttttcatccattacagtcaattttttgatgttcagcttgttttaggtcgcccctgctgtgtcagtggttcacactcaatcatgatggttgatgaggttcggggctcttaacgtgcaaaaagttctctaataaacaggtaggaggaaaaggagatgagtgtggtgttaagaagcctcatgaagaaagtgtttcatagaggatggattggctagctgtgtcatgctgctaataggacaggaaagatgaggtctgatgagtgatcattgagtggctattgatttggcaactggtccagtcattggtgatcttgataagacggatggtgggagtgaaaacagtgaaataggtttaggagtaattgagaggaaatcaattataatgaatatagataatagttttaaagaaatttactataaagagaagaaaaaagatggaatggtagctggaaagggaagtggggtcaagagaacatttattgttctcattgggttgttttattttttaaactttttgttttgaagtaattttagatttacagaagagttgcaaagacaagacagggttcctctatatccttcatccagctttcccaaatgtttaacgtagttgtggtatatttatcaaaactagggaatgaacagtacagctaaattggtacagtactattaaagcacagtttgttctgtttttttaagaggagtgaaataacagcctgattgtatgaaaaaccatggaagagtaattcagtgggactcagttagggaagtgacaccttcttctagaggatgatgtcatttattgagcatctgctatgtgcggtcactgagctagacattgaagataggaacgtataagacaaaggttatcttaggagcaagttaaatactttgggaaactatttttttgtaagtctaagtgataaaggtatcttctggaaataactgagtaacacattgagaacatttcgacaaaattgaaagtggaaatgctctggggcaacatatttttttgcacctatcactgtttgaaagagaagctatagcaaatggatgactgggtgagtcactggaatgatggatcttaggggcccaggggtagcagagtgggaaaggctgcacccatgctctggagggtaggaggattgttatatgggactcacagcacaaacacgtgtggatgcagtgattgtcaaatgatccaagggcatgtcttgttgctcctattttttttttcctgtctgaatggaaaacagcaatttcctccattcctggttattgcagatgatctgataatttaacctgagagccgttatttcatcttattttattttaaaactcaaaagaagtatactgttctcatcttaaacagtgagatgtctggtctttaatattactctttcttaacatacaataagctagcagtgtggtgatgacatgtagatacctcctaatgtgccataaaatcaaggcatgcattttaaaatgtttcgtgcccagaaatccaaacttttatagttgttgagcagccatcttcatatggtctgttctgaattcttaaaacctgcaggagctcatcagcctaacctggccccttccagctcatccccatgtcctattttgctatatttgagcataacaagattttatctcttcctttttaaaaattaattacctaataaatatgaccaaaaattgttaaataattttttaattacctaataaatgtgaccacaaatattaaataaaattatatagattaaaatgctgacgttctcttctcccccatcctattcccttgcctagaaggaacttctgtataaaaaacttgctgggtatccttttagaaattttatggtatattaatcttgtatacatatacaactgtgggtacctatacaactatgtctctctttcttttaatacacttcaaattcttgctatataccataatatacttaaccatatctccatgatggacatttaaattgtttggagtttttggctattacaagcaatattgcagtaaacctgtttgtataatttttctgcacatactcctgtagaattactagaagtgccatttctgaataaaaaattgactagtattaccaagttaccctataaaatgcctaatcagtttatattctaacagggtatgaaagtgcccatttctagccaacattagataccctcagtctcatacttaagtattttttttcccctaatcagttagatgaaaggtgatttttttaactaacaattttctgattgaattttctgattgttccgtaggcctgtctgtcttttcccctaatcagttagatgaaaggtgatttttttaactaacaattttctgattgaattttctgattgttccgtaggcctgtctgtcttagagactatagaagcccagagagaagaaacaaaaaatgaggcagattggttggctgtgtgggatggtgggaggaacatgacaccaggcttcaagagacctaaatcatgcccattctacaacttgtttcctgtgtgactcattccacctctctctgaaacctgctttccttatctgtcgctgtgggtaggactatgcaatttaaaattgctttcagctttacctttctataatttcatgatagaaaaatgggccttagagatcaaggttgactgtactgagagatgtctaaggagtatcttaactctcttcaaatatttgattgattcttgggatgactattgtttgtatctctggggttgacagaataagaagacattgtcttggactgaagcaagggaaaagtttggtttgatacaggggacttttggactatactgctgattaaattctggagtcagggctcaagagaaatagtggaattaccgttagtaagaaataaaactgacatttgcccattggggcttaaggtgtacttgactgagacagggactggattgatagttccccaggttcataaaaaggaagtgttttagacagttattaacttacgcattttgtggacctagaaactggtaagtttgctagttgttctttcttctaagttgattctcttgtttttttttcattgaacaatcaacaagataggaggtacccaggactgaaggttcatgaaatcagaggtccattataggaagcattttaatgctcaccctaataagtgaaatatatttcttactatctttaagcctttatattatttagaggccacagaaaaatccaaatccaaactgaacttaatgactagtgagcaacacatttaaatacacaagttttaccacattaaaggatgaaaagccagtcagcaacatgggatcatgttttaaaactgtctctggatgaatgaatatctctactctttcttcaagacccagtccctacagttgacaaccagggtggttctccaccaattcctggctcagggctttgctggaattgccaacattaccattagaaatcatttggggctgggcgcggtgactcacgcctgtaatctcagcactttgggaggccaaggtgggcaaatcacctgaggtcgggagttcaagaccagcctgaccaacatggagaaacactgtctttactaataatgtaaaaattagccgggcgtggtggtgcatgcctgtaatcccagctactcggcaggctgaggcaagagaattgcttgaacctgggaggtggaggttgtggtgagccgaaattgtgccattgcactccagcctgggcaacaagagcgaaactcagtctccaaaaaaaaaaaaaaaaaaaaaaatcatctgggagaattcccactctgcccgtcagaaccaagacagttggttccctttgtactcccacatgcataccatggcacctccccaagagctgctgctttctgttgccacacaactccctccctccctcccaaaaagaaagatgtagttctttgggtctttttttaaaaatattatatattttatatatttttttcaaacggagtcttgctctgtcacctaggctggagtgcagtggcatgatctcagctcactgcaactatctgcctcccgggttcaagtgattgtcctgcctcagcttcccgagtagctggggattacaggcacatgccaccacgcctaatttttgtatttttaatagagacagggtttcaccatgttggccaggctggtcttgaactcttgacctggcctctttgggtgttaagaaaggtataaagacttcacttttagtgactttgtctaatgttgaatgtgtcaaactctgaaaactaatccatgcaagaggttctggaaaagttccaggcaatatcactggagtatttattactctgaggaaatgcctttgataaggacagggttggtagcttcaatacctccctcattccccaatcatttgcaaaatccagtcacttttgcttctgaataactctcaaatctatccccttctttgctaagattcaagccagcagcccccacctagactaaagcactagcctctgcagcatctctgggatccctgcattttcctcattcagcagccagaaagacgttttaaaaaaatgcaaatctgatgtcatcagtggcctcctattaagccttacaacaaggaccagaatccttaccatggttcacgaggcccttctgcattgctgtcttctcagcacctagcacagttgtgtaggaattttaaaatgtgtatctgtttaacaaatcatttgatcccctcatccccacataaatgcacaggtctctcccgtagcctggcttcctctgctggagggacatgccgctgttgtgcaagggctggggaagcaagcaccagccaggttcagagagccattcatctgcagccagggttcattttcttagtctagccactgaaacgattgttatcaacaggaacctgtggtgaacatcactttgcttccttctctggcaacagctgcctcagaaacctagccaaaggctcattgggtcttgtccttagatctcatgtccacacacttccctgttcaaaactctaggagccaggtacaggaaacccagcctctcctgggaagctgcatcagtggttttggcgggtcatagtgcaggcagagcactaatcaccaggggcccaccctgcactactcacgcagttggcctccagcacttccagcagggctcttggaaacaagatctgtggcaacaactgggagtcagtgccgagcttctcctggccacacacaccagtcatcctcacccttcccgtcttgccagtcctttcaggacttgatcttcaatcttaggctgctgtgagccctagcaggacagagcccagactgtgtgctccctgcagcacagtgcccctatgccagctaggagctcagctagagtgggttgcacgagtcgtgagtttggggtcaacctattcctactaataagcactgtctacacctgagagctattcctgaacgattttgtggtttagagagggccatgatgaatatgtttagagtactgataaaatgtgcttcataagaaataaattagaatacctcctgctaatgtttttggaagctgctcccatcaagcatcagcaactctagtgaagcatggtcaacctggagatctgaaaaaatctgacaggcatttgactaatgtttacctttttgttacttataaaccattgataaataatttaagactttataaatattattacagtatttctgttaagatgggatatactacgcttcagtagccaataaatctcaaaatctcagtggctcaccttagcaaaggtttatttaacgcccatgtcaagatccatcttttttttttttttgacagggtcttgttctattgtccaggctggagtgcagtggtgtgcccacagctcactgcaccctcgacctcctgggctcaagcaattctctcactttagcctcccaagtagctggtacatgtaccaccacacccagcggattttttttttttttttttgcagaggcaagttcttgctatgttgcccaggctggtctcgaactcctgagctcaagcgatccttctgtctcagcctcccaaagtgctgggactataggcgtgagccaccacacccagcctcatggtccatcttgaactgtgctgagggtgttggagatgatgggctgggagtccctgaagcttttatcagacctgctcctgtctcattgccagaaccagtctcatggccccaaactgcaagagaagctggggagtagaggatatacttccatggatattgggtgggcactaacagtatctgccacattgattacctatcagcatgtgattaactgctacccacagagtacttaccatggaccaagcactttattcacatcttattaatcctcacaaaaatccaaagaggtgggtgccatttcaccccatttcacacttgaggcgattgatgctcagagctgtgaagaaactgaggaggttacacatgtagactgggtctagttagcatcctcaccagctctgtctgattccaaagcccagctgggcttttccactacaccaagcccaaaacagtgttactacttcattaacatagatttcctcaggctttccatgtgtcagtattttgaccttgtggctatatgcacttcagagcaatgcacctgcctttctttaagcagattagataagaattcttcttcctcccatcattgccctgccagtggtgctaaacttcacccactaccctctcctgagcctctgcaggtgaagtagttgaaaacagcttcccagtgaaagaatctggattcagccacaacatcgtaggaatgccacatttcaatcacctgataaccacctgatcacagtgggtttgcaggactcccctgcaaacccactgtgacagctgcagcctcacagacttaactgccaagtgcacaagcttcctcatgccaaaccctgtatgtctttgtggcttttactgtccgtgggacctggtcagtgcaaatgatggctttttaccctattggcaatcacagggaacttaacatttccttcagaaatgcctccacttgaaatgtacatgcaggatgttgagaatggattttagggcctttattatttaccacttgtagaaagcattttatttcacaagctgtgtttcaactgacagagaccctgtggccagtggtattcaactttggctgcacctagagtcctctgggagcttttaaaaatcctgatgcccacgccactccccagatcattcattcacaagctctgcaggcgagccccggcatcaggattttgtatagcttcctcagtgatttcaagctgctgctaacttaacaccctccactgtagactgatttttgccagaatcagcagggtgtagagaagcaagggagaaaaaacaagacctttaggaactgttagcctgacactagggccaaactctcttgaggaattcaaattattgtcacctttttttccccatagcaaatacagccaacataaatgtcaattaattaattgaaaaatgtacccaaagctgagcaatgtaaggccctctagcctggaaccgtttgcttttcaaagttgagtgtggtgtttttgtcctggcctgttgctgactagcatatatttttaaaatcatgatcctttaagatatgtgccaagagataatgtttttattaaatcaaaatgctgtatagacattgacttagttgtggaaaatgtcattaaaaaatagttgtcttctctttgaacagggccttcaacctctttaagctctgagggttgggtggggagtttgtcaagaagaaaaagctatgtgatgtggctgtacaaaggttttacattttgctctataaaaatatattacaaatgtttgtggttttgttttgtttttctgagatggagtcttgctctgtgcccagactggagtgcagtggtgcagtctcggctcactgcaatctctgcctcccaggttcaagcaattctcctgcctcagcctcccgagtagctgagattacaagcacccgccaccacgcccagctaatttttgtatttttagtagagacggggtttcaccacgttggccaggctggtctcgaactcctgacctcaggtgatcagcctgcctcagcctcccaaagtgctgggattacaggcatgagccaccatgcctggcctacaaatgttttattttaataaacttgcaaagggaaaagacttgcctcactaatttaaaaagttattcagaaataacttgcctcactaatttacttaaaagcttggaaacaatgtttgttagacactgatgtaaggttttttgcttattttaaaaaggtatttgtctccaccatcccagaaatgggaggtggctgtaccccttacttacctggtggcatctgagttccacttgccatctctttctacaaatgacgagaaagcacagcaagcctagctggctctgcagctttccatgggaactttgtcttcctccaccacgtcatcatgctgccaggagttagaaacttatagtgaatggggggtgtgggctggaatcctttggacatgaggccaggactgttcctagtgacacgataaacactcaatcctcacggtgcactaactcatagatgatttattgccgtaagtaactaaacaagagaagagacaggctgtgggtttggtcaagacaatcagcattccctctccaaggttcgccagttgcatctacctaaagccttaatactttctggacgatatacacatgataaacacagcatacatgggtaacaacttgaccaatgttacactgattaaaatagcacataacaagggcgccagccagtcccgatgccctgaagtgacagaagtaatgtggtttgtatgatgtgctgagtacaaaacctttaaaaacaactttttggcattaatactaacacagaatacttccttgaacattctgcaaaagtaggtgcagagacagaattacttcttcatttccagattaccagtatctataggactattttgagaaaagctgggaggcggagcacctcccctccccaatgtcattttctttgtcaaagcagaagagtcgaaggggtttaggtggaggagggcagctgacagggctcctggagttgttaagtcaccaagtagctgcaggggatggacactgccccacacgatgtgggatgaacagcagccttggtttgtagcccagggtgtccatggatttgacccgaatgctccctggaggccctgtggcgaggacaggcactggatggtccagaccctctggctggaggagtggtggagccaggactgggccttcagccatgagggctagaataacctgacctcttgcattctaacactgggtcattaatgacacctttccagtggatgtgcaaaaaccaacactgtcaggaacctggccctgggagggctcaggtgagctcacaaggagaggtcaagccaagccaaagggtaggtaacacacaacaccagggaaaccagcccccaaaccagctgttggtaagatgccttgggtttggcaactcacctagttttagcacaaattgcccaagactcagttttcttcaaccgtaccaagctctctgacttcctcagcatccccgtccctggcatcctctccaggattggagtgcccagtgcaaatccccaccagggccctgctgtggctggcaggaccattctgcacagcctcaccctccacacccaccccacacagcaggccaccaggggacagctgttctcccttgtcctcttggacagggcccttcatctcctcggagactccaccctcctgctgctgtcctgaaacacagtttcccatgtctccagctttggaagactggtcttctaagttcttctcattttcttctgcttgttgtttgtctctggcactgagtttaccttttgatttcctcatctgcctgttgtgcatttcttctctggagaatcgccactgaaactagaaatcagaaaggatggggataaataacaagcctccgggaacccagagcttcacccaaagccttgtttgcattcatacccacaccatgtctgagtgagacatacaattcccagcatcccccagccaggcagtacaggcaccaaacttgaatcgcacactatcacatcacacccaccccaagagcctgcaccacaccttccaggatgtgtattttagatgtagatttcaggttctgttggggcagagcagtatttcttttgactggctctataccaaaggcccacataggaaagggctcctaaagtcctatcatttggagggccaggatggagaggagatgtgaggcctgcccccagtaagagccagagctgcagctactcatttccattctgagcaggctgaggattaccaggcacggggctggcattctctcactaggtcacctgagtaaggcagggcccagaacatggggcagacactgtgctgtaccgctcagatccccccacaggactggcgggcccgctccccagctaggccgatagccctttgctgaccaccacctcacagaagggtcacaccagggcaacctacaaccaatgactgccccaggtgggatacaacaacccatttcctgatcccaatttgggataacgcaaatgccatcccagctccaagccaacctgggggattgtgactgcatcacagcccaaattctccctctgcccgctactgtaccgacaagtgttctaaggtaactccctctaaaaacttccaatctcagaggccgcttcccgggggcccaacctgcaaccaagcatttcctggtgtgacagggaagtcaggggctcagagtcccaaggtcacgcggccagtaatagagttgggcaacaaccagggtctcatcaaatctctggagcaagaccacccgagagcgagccccagctccgtcactgaccggccaagtttctcaatctgaatttctcatctcggtggcccagagtgcacgtggggttttagttttcagttcccaccatggccacttccttgtgcttcagctgttatctcattggtttcaccaaatacgcacttaaatcttagacattatataattgagagaaaaagggagctctcagttcctatgatttcttgctgggctagagagaggagcccaggaatgcagttgcaccatcagtgggaaatgatttcttaaggctttagtatgttgtaaatcattctgagcgctttgctaggaaaaaccaaaaatgtgctatgtaaatgtttaaaaatctgccatttttgtagttttccacggtagagatctgtttcctcagataaaacatttgcccaaacacagaattctgagatttaatacattataggattcttggatttagcaccttttagataagaatggtaatggaatgttccattaaagtagagaaacatgagtgaaatacatgttgaggttaggatttaacatttatctggtcctttcccaccctgtatcccccaaaaaacccaaatgagttcacttacaatgttggatgggtttctcctttgacttcttttgaaatgtctcgtactgtagctgacagacttcccttaggagatgggtggagcttcttccacccaaactgtgaggatcccaataatggaatcactctgtaggctaagtggtgtctcagacccacctcctacttaagccgagcctgccaggcaggcatctcgaggctccaaacccaccagaggaggcccctgattttagccctcagcatgaccgtggctgcctccaccaagcctccatagtttccaggcaccgtgttatggttcgtaactgctgccctgtgttaggcagctgccgttgcattttaattccagcccaaatgtaagagtctctccttttttttaatggatgttccaaaacagtcagagcctcttcacattttatatcattttacgtgtttttagaaaaggaccagtgaagcctacctgtgtagtatagtactccgagaggcagttggctctcagggaagtcagaggaagttttactgttgccaaaaaagtggtgattgttttggctaagaggccttaagtgctaaaatgtcaaagcattatagtatgggttcaaatcctagtgctggcactcattagctgtcagtctttaggcaggttatgaatctgagtttcaagttactcatctctaaaatggttgtctctacctccagggctgcggtgcacacctccagggccccattcatattgtatttgatgtgaatagcgccctctgctgttgtgcagtgtacaactgaggacaattccaccacgtgctagaccttccatctaatatgagcccagatactctctccggggctgctcttgctaaataacagagcttccatagtttcccctggatgcctggccacatccagtttcctgtagaagatcacatcttgttgatctgctgatataatacaaaacgagaacacaaatggtagaaaacaaacaacaaaaactgtttcagatcccaacaattcaaaaaggagacgtctcagaaagcaagaggaggcctggactgtgccagatttcagttgagcctctgaggtgagctctgacatccacaccacttaaaggcaggcaagtccagcctggggaatggactccaggttttgagtaggaccgggggagtctctgagcttaaccagcaagccgcagataaaacaggttgcactgagttgggggccttcccaagccagagcatctgtggcagttgggtgtgtcaccaaatccaattagccgcccaattcagaaataactgtctaaaagaaaaaaagaaatccttcactttacagcagtgtgtgtccagagttccatgtcagcaggagccaatggatttaatttgcacattttaaaaactgcccatgatgtgtccacttcaagtagtttagctggaaggaagtcttcccgagttgtagaaatcacctactccctttgaagaagtttaatatttgccttgaaaatcacacgcacgtacacagaggtttctttccaatgctgaaaagtcctgattagaaaaatctatccatgttgctgattaaaagaagactaaatatgccacatcctcggtgtgccaatcttgcagtttcttttcttaagttttaatgctagacatactatgtgtgtcctcgctaagaagctgattactcattcattgattcgacaagtatctgttgagcaccaactaaaatctgggtacacaacacaggaaaaaggtctttgctcttgtggagactatgtctgactctgcctgggaaggataaaataatgatcacaaataactaaaagcccaaaggagagctctgaaggagaagaacgtggttcttttccagggtagtacaaaggagtctggtttggtataaaaggagacagcactgttctgagaaaaggatgctcgagtagagctagaaaggaggagaatgtccttggcagaggggacacggaagaactggaggccacagaggagctggaggccacagagaatgggaggctggcagaggaggtaagagggaccagatcccttggggccttgagggccacagtactgatttccatctttgtcttcagagtcatacaaaactagaactcctttgagcagtgggatgacaggattcaagttccctttttaacagatcacttgggctctgaatagggaacctatttgaaggggatatctattattaggagattagaatagctgaggcgagtgatggtagagagaagtggagggattccagagcctccgggacctaacacagatgggtcttaaggatagattgaatataggggaaggagaggggagggtcagcagggatagcccctaaggtgcaatgccattcctctagatagggtggcggttggccaggtgggcgaggtatggggagggggacagtcataggtttcctcgagccacaggatggatggagctggagtcttggggtgcagtgagggctgaaaatgcaggcggaatggtcattggcacagaggtggtgaaggagattttctaaggaagaggcaagagtgaagggagaaatggggctgggtctgaaccctgaggaacttagtgggaaaccaggagaatgaggtgggaaagaaccaagagaaaagctgcttcagggagtgggggtggtcccaacatccgggctgcaagagctcaggcatgatgaggactagatggagtgactctcggtcaccaggggacacaggcctgtgggagtaggacgctgacccttgtcagctgaggagtgaggaggggacacccagtgcagaagattcttccaaggagtctggctgtgaagcccccctctctggaggactcccatctgtgaggtgacccagagggtcttgtgtagaacaagtgctccacaccagtcacctacagtcttggaatgaggcaggaaataattaggtacatggaaagagaaagcagtccacccagatgagtacagctgcttgggattagaagtttttactgactgaaaaaacagtgggtcccatcctctctgaattttccctgaggagagtcagttcaaccttattacagcagcttttacaaatctatctctaaagtctccctgccgactcaagtttccactgacttgtccccctgcatgcgatgccatgaccttcacaccaacatccaaccacatgtctctcctttggaatctgtgtgccccaccaccaggaacctgttaggcaaaggtggcaccatctccctctgtaaggctgcagcgggtgtctgtcagcatctgacaggggccctttgcgtgctgtgtgttgaatgttgcacttgctgaatgcatgcagttcccgtgagcctgtggctgagctgaaactgacagcgctctgcagccgatccatcttccagctggtggctgcctgctcctggtggttgatggtgggctggcagttcccttctggtccattgtgccgtcacctgtcacattacaccttcagagcctggagaaagaccttcctccacactccagcccatctggcttcaagtcaccattgctttggcactccttccacaagtgggctccccctggagttgttggctggtgaggggctgctccaatctgttcatttacttgatgctccttcccagggctctgtgtccaaagaacatgaggaaccaagcgtgaggaatgcaggagtgatgccaggagtgaggagccgagcaggtcaggcaggccctgccgagaatgtggcctcagccatcaaaggtgcagtgagctgaatccaggtgatgcctgactcaggctttggtgtgtccactcgactcactggcctcttccccagcaactggtgaaaatgtcctcaggaaaagcaccacaggctgctcagggtggggtgggaagcatcagaatcatctggcacaagggttgccgacacttgcacctcgtacagcccttgtgctcaaccttcaggaatcacagagaagactctctgagaaggccagtctctgtgcgactgtttctagggtagttcagagtccggagagggggaaaagggccctggggatctcttgaggacagcctggcctgaggacttgctgccacaggctacagctagcatcaccagctgtcacacagaggcctttgggtctaggcctgtcatgaagaaattttggcagggtctctgcttagatccccacacttttaatgtcctaaggaatcttaacagggcaggccagagctccaactagctgataatgagattaagacacaaagaaactggccatgagctcgagccatccccaccccatggtcaggctgcagctgacttcgtgcccttcttttcatcctagtgggaatatctagcaggctgaagcctccagaagagcctctctcctccatccttctggccggcccagcaggacgatggcagacaaggccctccagtcccctcagctgtcccgttttagcagcctgagatgtgattcgggttgccaggggctcaggtgttccttgggctctgcgagcccttggaagctggagcaggctgccccctcaaatgctgcagaaaatccactgaagatgaagccctgctgaggaaaacctaggaaggccatcaaagtctcttaccttcgattccttcttcttgattttctgaggtagacaaggtctctgaagaaagacaatctgcttggtggatacactcccctcgctgtaacacacggagctgagaatgagccactttatgccttagaggaacccaaaacctgacacagatgttgccatccctaatttcatcaaagcagaccacccacaggattatgacaggttagaagagacgcctgctctactcttccgctcccaggccatccaaccttgcttccgaggggctatctcagatgcccaacaaaagctttttgggtatccctacaaagtcagcttcctagctggacacgcccattcccttaatgggaagtaacagcatcttggccaaatgtggacacactggctgcttcagtggatctcaaaggggcaggggccttttccaaatctgtctctggtaatgatgggcaggtagataaggacctgggtgatgagctcagccctccagctgctacaggacagtggacagaggtcatggctgcatccagggtctcagccatgcatggctcctgcaggcacaccaaagactgcacagcaccaggcgggccctgcaaggcagtgcctgttaaccagctctggctcacatgcgagggaggggcgactcgtatcttacaatacagtgaattctctcttcccaggaaggcaggacctggagctgcctctaaagatgatagaagtattgtaaagaagatcactgttttttttttcccctgcttccacccttctgatgattttgtattttatttttaatttacaaataataattgtatatttatggggtagagtgtgatgttttgatatatgtttacaatgtggactgattaaatcaggctacttaacaaatccatcacctcacatacttagcactttttgtggtgaaaacatttaaaagctactcttttaggaactgtaaactatacaaggcattattgtttataatagtcaccattctgtgcaatagatgaccaaggcttattcctcctaactgaaactttgtaccctttgatcaacatctctcgtttgcccatccgccccactccccagcctctggtaaacaccattctactctctgcttctatgactcaacttttttagattccacgtatgagagagattataaggtatgtcattctgtgcctggtttatttcacttagcatagtgtcttccaggctcatccttgtaataaataacagaatgtccctgacccccccccttttaaggttgcatagtattccattgtgtgtgtgtgtgtgtgtgtgtgtgtgtgtgtgtgtgtattttatatatatatatcacattttcttcatccatctgatgagggacacctaagttgtttccatttcttagctgttgtgaataatgctgcaaggatcatggaaatgcagatccctcttctgcatactgatttcagttcctttggatatatacctagaagtgggtttgctggatcatgtgctaagtctatctttagttttctgagaaacctctgtactattttccataatggctatattaatttacaatcccaccaagagtgtacaagggttctcttttctctatacccttgtcttttttataatagccatcccaatcagtgtgaggctatatctcactgtggttttaatttgcatttcttaaatctgttttgtaaatttctttacatgttactgcattcagctacaaagtctgtaagaaaaaggagggagagaactaatatttactctgcacctattttgtgtagcggctaggctgggtgaattcacacataatggctcatttaagcttcacctcaatgctccacggaatccaactaccacttttatagaaggaaacaaaagctcagctcaagagcaggctggagatcacacagtgaggattcaaacacagatctacccagttccacacagtctccattccaccgtaagtggtcatttaaggaacagggaggtggaggattaggaaggattatttagcaggtgtgaaggtctgagacagagagacctgtctgtagcccctgggcttaggtggctcagaaccagctgggccttcacattcaaatacattctgagtcttgtcttctggaaattgaccaggaaactgactcagagaagctatgtcacttgaccaacatgacacagtgggtaagtggcagactgaagacttgggttcaagtcttcaggccccaaatccagggttctttctacaccactgcattgccctatgcctgtcgaagtcttggctgagaaagaacatggtggtttccagtggccaaggggctcaaaagtggccgcagactggctccccctggtgcactgacccactgtgacctaatgtggaatctgaggatcctggtgagccagaggagggactaggaaagacatcagttgtcaccatgattctgcactctcaatcaccctggtttgccagccttgccccatgctgtccatcactctgcagtggtgaatatgcagtagggcttggggaaggtggagctctgggggccacagcgggggcatccttgctggtcagcagagagacggcctgctccaggaaaagtgcctgattctgcagactgaggttctaggcccagtttctgccacttactggctgggtagccttaagtatgtgaccaagcctcccctagcctcagtttcctcatctgcaaaatgggaatcatatccatgcttacaaccccacagggcaagactaatttggatagtaagcccaacatatagatggagggccttttatggttggtgtgactgggctcaagggagcgtaagcagagctgagagtggacaaatgagcatgaacctgaaattataaggaatgccgcaccaaggcctgaaaggcaggcctttacagcccctttgtggagctggtgaccagtgcttgatcttggccaagtccctcaacctccctggctacactttcctcagctgcaaaatgggtttaataataatacaattctacctcatagtatttttcttttctttttgaggactgagatttttatatataaagtgcctacctagcctagcacaaggcacatagtaggtgctgaatttcttttgcattggaggctctgagccctctcagtctgagcggctcatctttgacattctgggcagtaatgactcacagggccccccatgtgggaagaggggtgcaggggagttctctgggtgacggtggttaagaatgtgaaattctggctctgctgcttcccagtgggagagtttacataactaccagcctcttgcacaggattaaataatttatagacgtgaggtgctcattaggaacagtgactagcacagagtaagtgttcaatagaatcctaatgattactgttattgttacctggtagtcttgacgacgggagttggtagcacacaggtgagctgccagccataggccgccagcgagttcagcaggggcacgtagtctgtctgcacttcgacaccctgggggaacaaggccagcattagggctgctgctgccacaagccaactcccaggcaatgagaggggactattcagtctgccaatccgcaaaacagaaaagaagtggcggtgcccggccactcagaggctcctgctccgatgcttgctgaagactttaaaagtttggagtcaaactgccaacatgggatttccttctgggccccatttcagtctgtgatgtcagcaaggaattacagccaaaagattaatccattaattttgtttgattcttgtctggacaaatagcctcctgtgagtttcactgacgaagcataactgtctcacctctgagcggtatccagggcatataactacacgtgctgctctgaatgagttcagagcgtgttgtggggagttaacttacatttgacaaatgatcaagtcgtttatgtccagccacagcaacacacacatgcacatccacatgtgtgtgtacacgcagaagctgctttgcctgtgttatgtgccctgccttgcagggataaatgaatgctgccatgttttatttcaaattaggatttggggaactaacatttgtctttcagttaaaaaactcagccccggccgggtgctgtggctcacgtctgtaatcccagcactttgggaggctgaggcaggtggatcacatggtcaggagatcaagaccatcctggctaacacagtgaaaccccgtctctactaaaaatacaaaaaaaattagccaggcctggtggcgggcgcctgtagtcccagctactcgggaggctgaggcaggagaatggcgtgaacccgggaggtggagcttgcagtgagctgagatggcaccactgcactccagcctgggtgacagagcgggattcccatctcaaaaaaaaaaacaaaacgaaaaaaacttcagccccctgctagcacagggagagagccctgatgtgaggcccctgcactggcttccacctctgcaggcgttctcactgcaacaggcctcatttcttactacgggttcctcactaacactcaaagtgtagcccccacccctgctctgtgtgtaactggactcctcatccctcatagtttggcttcttgtagttggcttccgaaaatctcaaacatgtatccagattccttccaccctgtatgcccacatagttcatttatcaggtactctagagccatgatgggtgcaaaggcacagccccggcccctggagttcacaggctagcaggggcaacagcacaaacatgccaggaactgaaaaacctaagggctctctggcagggccatgggactttgaatgccagcagaggtgggagagatcccagccacagtcaaagcaggcttcctggggcaaaaattagaaggcaaagctgggcctagagtgccaaggtctgtggtcggcttaactcagaggcagcgcgcgtgaccatggtctggagtgctccactcagaaggtggccacgtgtggtgagtggctatcctgctggtggccctttgggaacaaaaccagctcatctggatgccctgggcgagtgggatggaaggcagaggaggaacaacctacctgccctgtctcttcaaatggcttttaaagcttctataactggacaccagttccagagtggctatcaagtcacctgaacccttggcgactaatttatcccttggcagcctccctttcctccgctgtataaaatgggtactggtctatgtcggttcccaaagcatggcccgagccggcagcatcagcatcacctggcaacttgttagaagcccagattctcagggccccatcccagacctgatgaatcaggaactccgggagtagggccccggaatctgtgttttaaaaagcccttcccagtagtcctgatgcagctaagtctgagaaccatcgcctaggtaatcatgtaggtccctcctggcaaaagaaaagtctgtaattctgtggccagaatctatcagctgttgcctcaaatctaactttttcccatcattctccatgagaaaaaaatatatatttttaaaggatcagctctgttagaaattctgccacactgcaaggggagaaaagaaggaaagtgctaaggtttgaatgtatcccccaaaaagtttccatgtgttgaaaacttaatccccaatgcaatgacattgaatggtgaggcctggtgggagtgtttaggtcagaagggctccactcttgtgaatgggttaatgccaactcaggcaaagggcttgaggctacaagttcagtctcctgctctctcccctcttttctgcgcttccgcctcgggatgacgcagcaagaaggccctcacaagatgccaggccctcgaccttggacttcccagcctccaggaccaggagccaagaactgtctgtcctttataaattgcctgatctcaggtatcctgttacaacagcacaagtggaccgagacagggcggaagtggagaaagggaaagggaaagaggaaacttaataaaggaaggcggaagggaggagggaagggaggaaaggagagagaggtacaagaataatccgtttacaggtggggccaggagagaatgccattctggtcccttccctgaagcctctatcaggccagagatggcccagcagttgtgaccatcctttctgcctggcctctgggcacacgcacacctcccttccagaccagcacagcccgtattcctcctgctgggtgccacgctcaccacctgctgaaggagtcctgaggctgctttatcctgagaatccctgcccccatccccgtattcccagtttaaagagaggaggaaaaccaattttaaatccacactctcaagctttgcgaggttatgattacttgggcctatcaagaataaccttcccactttatcaagcactgtgacaaacccgccacaatcagacagtagccatggcaaccaggacaagctttggcgcctcacaaagccctgagtggcagaatggagtccttttattggtggctgcatctcgggccaggttttctctgcgggcacccagagctgcgagacaatgaacgacccctgctgcagcccgacccgcctgcttagacagactgcaaaccggctgcttctattttgctccgttttatttcattttgtcactctcttaaagaaaaaatcagcaggatttctcccaaacattttttccccctcagggtaggagatgtcagccagagggtacagaatcataaaggccaaaagcaaaagggaaaacacaacaaaacaaccctgcttgagagagctgaaggttcaatctcacgtgttaatttctggccatcacatggtgagttgacaagtaaaatacaaatggtaggggtgagatgttgcactctgccagactctcccactccgactatttggaatggtcttggcttaattaatgttaaatgtgattttccgtaagcatctatcacagcccgtttgcatatttatcaatatagtaaagagatggcatttctaaaatacaagatgagcctgtcagtgaaagacacttttaagtccattagctaagaaaggtggtaggaaacatatccggatggaaggctctctttgatctgcttttttgtgacactccagtgaggagagaagaaagcaccaacaacactcaaaagccagcctgcttatcaaacaaaaagacatttctttctctgagtaggagcaaaaattttaattaactctccactctcctgtggtggatacgtaatctccgatcacacctggagtgttaaaaaatggagcatgtcctgtggtttttcaactcgtataaaaggaattcatttgtatttatggctcttttttcctttgttccctataatttctccagtgattgcaaatcaactaaagaaatagacatcctacacaacctttctttaccctccaaaaattaggacaacagaatgtagagtttactaagaaatatgtttgtcttttgatgatttaaaagatcttctatgcagagaaataattaggaattcataaattggtccagtgagaaagtttgcattctgaatgtcagtttgctcttcttttctcctgtgtttcatcctgtggaagcaatctaggagaaaaggagtttgaaagaaaatattttgctctttatacatgattgtaaatgaagaaaggaatttgatttcccttgtctgaaaggtgcttgagaccacttctggggtgttctccatacctgagaaaagtgactggggacagtttgcctctattcctgacatccacaggactgagaccttgcctttcaccaattagggtatgtaagggagagtcctgcaaaaactacttctgtgtcttttgtaaaattgctaccaaaacactagtgcccacaaattactggcagggtgtgcttatactactcttattttacttatcagttttaggtatcctaattttctaccatgggaaataaaggtttagtgctcccataaacatttcttatttcctttttctttgtgctccaaatggttattttgtaatttaaagtaaatcaaaagtcaatgtttgtgttatcacagttttgcaaatattgctcaatgctgggtcaaataatgcactatgaccatgccttcttttttatataaccctctgtttttcctggagttaattattacctccatttttttcatcttcctggttgtacctgaacccatcactaatttatcccacatgttgcaatacccctatttaatgctcatcgataaatattccaagatcctaaatacattagttccatttttccccactggagacatcatttctgaaactttgctctaatctggtctggctgcttttcatgcctgggttcttcgtaaattactgtctatggctggtatgttctctttttttggtttccttctcattttgcaggagcacatcctgtagtgactctctaggcaacaatgccctagaagtcatctgaatccgtgcatttctaaaaatgcctttgtgttaactaatagtttaggtacagacgtctgggctgaaattgatttatccgtcaaaattttgaaagtacctctagtagtttctagatgtcagcaatgctattgagataatctattctgattactaatattttaactgtaacctgttgtattgctttgaaagtttttaggattttttttttctcccctagaagttccggaatttcatgacaatgtgctttggtgtgggtcttttttactcaaaggattgttcacctgatggccttgcaatctgaagattcttgtccttcagttctgaaaaatgtatttttcccccctttgataagttttctcccctcccttttctatcttctttttttctggacctgctattaatcaaaatgtgtgataaatgttttaattttattaccttcccccacagttttcttactcttttaattttgctttctgagagatttccttcattttgtcttccaacttttatgttttttaaattttctgctgccctatttttaagattcaaaagccctttcttatcttttgattgcttcttttttttttttacagcatcttgtttttgcttcatggatacatttattttatctctttaaatggtttcttctgatacctacattatctccacggttcccaggttgcatgtgacagagatggggaactagggatcttaccacgccacgttaggattttaaaccagtaccctggttttctgctctgcagttcacatcccccaacctcccatcccatggtgatttatgctttgaaaaccaaagcttttcttgggttctgcaagaaacaaatggcacccttctcgtccaggttgtagcttccttcattttgctaaattagttagattcctctatctactttccatctatctaaaaatttgttgaaatcactcatcttctactttatcttcttctaatctttttgttcttgtgggcatcgatttatctacctacctacctacctacaattgaacctcattattcttggtagctatgttctgtaaagtcattgtgaacagtgcattagtgactattgaaccattgcccataagagaaatatagggttagggtcttggaagcatctggtcgcaacagttttgcaaactgatcaatatataaccttgtttaatagatagtgttgattcatgaacattgaacttgcagccaacagcactataactcatgcctgaacaaagctcactggtatttgctttgtaaagcacatcatagcattcctgcacttaggaacactaggcaacagtacttcagcactatgcataggggctatttttaacagctaaatcaccaacaaaaagcacaaaaatgtgaaaaatgtggcactatgtgtaccacaaaaaggacacttgcttttagtatgaacattgaaaccaggcacaatattaccttgtttgaccttagctagaaaagtgcacattaggcaactcaaaatttttgctgttctgcacatgtttgcaaatggccacaaaatgccatttgtattgattttgggattacaataaattttagtaagcagatgaatttgcaaatacagaatctgagaatatgagaattgcctgtatctatctaattatgtcattcctttagtttcatttcatgaggatttttcagaaaagaaatagatgcctgtgtccaatccccctcatttaataaaatgttattattttaatgtttaaagtgaacactggaaggcctttctaaataacttagaatccagaaaccaaaaaataaaaatgacaaatttgattacataaaaactcatatgatataaaagacaaatgacaaaatggaaaaatgtttgcagctcatattacagaaaaaaaagggcttgtaaaaattgaaaagaaaaaatccaataatccaaattttaaaagggccaaagatatgaagagagatcacagaagattcaaacacccactaagtgcatgagagaaatgcagaatctcataagaaaaatgcaaattaaaactaccagccgggcgtggtggctcacgcctgtaatcccagcactttgggaggccgacgcgggtagagcacgaggtcaggagatcgagaccatccgggctaacacggtgaaaccccgtctctactaaaaatttaaaaaattagccgggcatggtggcgggtgcctgtagtcccagctacttgggaggctgaggcaggagaatggcttgaacctaggaggcagaagctgcagtgagccgagatcgtgccactgcactccagcctgggcgacagagcaagactctgtctcaaaacaaaaacaaaaacaaaaaacaacaacaaaaaataccctgagatactattttttcacctattgaactggtaaaaacccaaaagttaggcagcccgctttgttgccaaggccgtggggaagcatgcgttcttgtacattgctagtggaagggctcattgattcaaccctcctggagaacagtttgacagtatctttcaaaattacaaacacattttccctttgacccaacaatctcacttctgggaatttaacctacgtattaaaaaatgagaaatgcacagagttattcactggagagcggtctgcagtagcaagacactggaaactactcaagtgcccatcagtgctggatttgtatttaacattatgtttcacccagacaacagctcagagaactgggcaatggctgctcatgtgttgagccggggcatacaggatgaagagggacaatgagagggaatgaattctattctagacaccctgagtttgaggaacctatggaaatgtccaggaggcaactaaatgaaacagcctgtggtagacagaataatggccccaaagatgtctacagcctaatcccaggagcctgtgaaaatgttcccttcgcatggtaaagggatgtggcagatatgattaagctaaggatcttgagatggagagtttatccaggattatccaggtgtgcccagtataatcacaggggtccttataaggacaggcaggaaggccagagtcagaggaagagatgtgatggcagcagcagaggctggagtgatgcagggaaggggccacgagccaaggaacatgggcagcttccagaagctggcaatggtcggtaacagattgtctcctaaaagtctccacaaagaatgtggtcctgtcaacaccttggttttagccccttaatactcatttcagacttctgactcaacaaatgtaagacaataaacttgcgttgttttaagtcactaaatctgtgatttgttgccgcagcaacaggaaattaatccacagctcagggccaggaaaaggctgggatggggataaacacttggaggtgctgacagatgcagggtaggtgaaaactcctggagggatgaggctggctgagggctggatttccttgtgagggggtgagcagaagatgaacgaaaatgggctgagtgggaaggaatcagcccttggacaatcctgcatgggaaacaggcttaagaagggagtttgtaccacattttctttatccagtccataatgctatgcagccttaaaaaggaacgaatcacgtcctttgtggggacatggatggagctggaagctgttatccttagcaaactaacgcaggaacagaaaatcaaacaccacatgttctcacttacaagtgggagagctgaacggtgaaaacacatgtgaaaacacatggacacatggtggggagcaacacacactgggacctgttggaggtgtgggaggagggagagcatcaggaaaaatagctaatggatgctgggcttcatacctaggtgatagcctgatctgagcagcaacacacatggcacacgtttacctatgtaacaagcctgcatatcctgcacttgcaccctggaactttaaaaaaaaaaaaaaaaaaaggagtttgatcacaccatcaaatatctcaagagggcaagtcacaaggagcctggaaactggatggatggatggtgaggtctcaggaggccacaggcaggactccgcaggagggaagtggccgacagcaaggactggtggcagctgctagtgcagaggaggcagagcatgctggcgccttctcagggctgcctgggccctgctcagcacacgctggctatagcggcactcgaggagggtagaggtcctgttctcctacggccatggaaagtggagatctagaggcagggtggacaggaatgccaagacagaaagaagggccacttcacctctacctctccctagcaagtggaaggcagatgctggaacacggcgggcagtgttgcagaaaactccacgtggccctcaggatgctaaagggcagggctatgcctggtatcactgttcattcatgaatctcacattcagtcagcctggctctgtctgtgccacttgggaagcctcttctgccccaggagatcccagtctaggggtggggagaacaagcacatggttcccatccagtggagcccatggaggtgaggtggagggagggagaagggaaggggcgacctgctgctctgtggagaaacagcaaagccctctgcagccagcacagctggccttcctcaccctcagcctcccaggcctctgcgggagggagggacaggcacgctggccggctagagatgttgttttctcctttgttttatgcacaatgccccagaaaaacattttgctgatatgtaatcaggacaacataatagagtctgagagagcagtcttctcattttagacaacttaggctttcataatgttcaaagagaataattttttttttttaaaaaagcttagttcttagatgcagaaaagggtcagaggaaaatacatgtagtgcataaaaagcttcagttctgagactctttacccacccagtgctggtgaattcacatctttgtctcattttctctaccaggtaagaaaggcagcaaactcagtagccttttaggagctcaacgaaataaaaaataataattgttattattacatgaaacatattgtttggaagaatggtgtctattatgacttccctgtgtccaggccactttccaacacagctcggcagctcctcccataagagggagagtccctctggtcaccccttgaatcttggctggtcttgggacttgctctgacaaataggatatggcagatgtgacattacggtcatcctgaacctaggcctcaaggagccttgctgtttctgctcactctccaggaaccctgcctacgccatgaggacaggcccaggctagccttcggatgatgagagacctgtggccctgctaagcagcagacgtgagagatgccatcttggagctgctagctgtggtccacccatcagcgcctgcaggcacatgctgagattagtcgatttcctaaaagttgaaggaaaaatcacccagctgacctgtttgggttatgattttaactcactaagctttggggagctttattacacagcagaagctaactggtgtattactattattactattattctaagaaccaaataccaggcaaacctctaggaggaaaattgtaatgaaagtcacctcattgatttgtggccgggctcagtggctcacgcctgtaatctctgcactttgggaggcagaggtgggtggatcatgaggtcaggagatcgagaccaccctggccaacatggtgaaacctcgtctctactaaaaatacaaaaattagccaagcatggtggcaggcgcctgtagtcccagctactcgggaggctgaggcaggagaatcgcttgaacccaggaggcggaggttgcagtgagcccagattgcgccactgcactccagcctggcgacagagcgagactccatctcaaaaaaaaaaaaaaaaagaaaagaaagtcacctcatttgatttgagagaaatacaatgatatagttactgctgaaggggagtgttcctaatttgtcaccacactcaaggctggcacacctagcccttatttgctccaggccggacactttggccttgcattacctctggagccctgaagtctaatttatgataacctactgtgaggcccagcagtgccaccagcttgccctggaagagagagataaaaacccacactgggtagatcgtcctagctcgagatgttgccctggcttctcctaaagcaccatgccaagctggcaagaaaaccaaacctgcatgtgcaagataacattctcctggattctgggacacgctgggtgatctggtcctggtacatgcggtttctctaacgtcagttacttggaaggcagaaagaagaaaggggctacgggatggaagggcaggagatggcatgcatccttattatcaggggtgtctgcccacacacacctgcatgagcagaatgagaaccaggcaaggcatgcaaccacgcaaggctcctgatcacagggaaggtaatgaggccggacatgcggcggctaaggggcgatggctggggccaactctgacccgtagcagggacaggcactgcagttctgactgtggttaagcaacacaaagctgccacatcctgtcagctgctcatcgggaccacgtatgcaatagcacagggctcctgtcctctagaagctgacatcttaaacacacattgagtgcttcagggtgagggggtcctcccaggccaacttagaaatagctttgtttgataacaattaaaaaagaaacattttctccatccagagacttgccaggtccctcctactggctttgatgagagagaaaactaggctttctgggagtaaatgggacttgctactttattactctctttagactatcagagatgaatgagggatcctatatcatatctttagcccttctttctgatttttcaccttatgtattacctagaaaagagaaaagggattgaaaaaaggagcttttccaaagtgtataattaaaaagttgtttattttggagttggggacctggggagagagccagtctgtctgcaggaattctagaacccaaaactgtcaacgttgtcccctccacctgtcagcagtggattcctaacagcttactgataatcataaaatgcaaacccagaagaggtctctgaataaaggttggttcaaaaccttaagagacagggaaatggagattaaagattatttcactgtcctagctaacaacgaacagagccacacaacacaccatgtgctgggctgtcacagtcttgactcactaaggaagggattgggtaagacatgggatttctctctccctaactttctctgcctggtaacttcaaaggtgccacattctcaagccatgctggagcaatcacagttggccaatattctctttgtggtgactcaactgtcagtatcatgttgctatggctaccacaattctcactcagccctccctccttatgctctgctcttatttaaaccaaattgcattgcactaatcccacagcatgctctttgaggacccagctctgatagggcttctgaggtgccagaaacctccagctggaatatcctgccttcaggacacatcagacatctggctgttcattagtccaatgttacaagtcctgcagtccacctcccattctatctggctccctgctctaccagagacaaatccaccagagccataacagatgcgctgccgggtccccatcagcatctgcactgagacctaccacgggacaaaccaatgatgaaaaacccaaagtccagaaaatgaaaatggtctcagagagactggccaatcctatttggggtcctctagaaaattctcccatcactcttccctgtcctaccatttccacatattgatcatgacttggtgcttcgtttttctgcccctgcactagaacacaaactccacaaaggcaaggagtttatcttgttcttgatgaatcccaggcacttaaggaagtatttgttcgataattagttgttgagtgagtgaataaatgcacctgtcctagcattttgtgggtaggttctgccaccattgtcttgtactctcaaagtcttatcaaaattgctgtaaatcatgcctaaaatgagacatgagtttgccaccaaaaatgtgaattaatttgccaggatgctgtgttaccatttttatgggtattttgcatgtggaagttggaagtatattcacgtatgaaaattagacacagtcatgtactggccataaagcacaaggccattatttagctagccacacacaaacttgtttcttccctgtttctgttccattgccacgcattacagagggtcctatcaggaggtagtgcctgtttctccatctcttgactctgagctggttttgtgactttctttggccaatagtacattaacaaatatgatgcaaaccgcagcatgaaataagctagcacattggggcttgcccacttgctgcttttgggaatcctgtggctgccatcctgtgaagaggttcaggttagcttactgaatgttaagatacacaaggctctgttctagccaactgccagacatatgaatgaggccactctagatcattcagctaccagctgacatatgagagagcccagcagagatcagcaaggttgccctatggctgaaaaattgatcagatgacctaaagaatcatgagctaatacatggttatttgaagccactaagtttggaatggttagttacacagcagaagccaactgatagagactgaaaaacaaaacatccaacaaacatttaatggagatgagtgtttctgcttctttcaaagttaccttgtctttatacaggaaggtaactctgcagttatagattttaaatagaataatgcttttgtgctaatccctacccctcaccttcttgtccaaaccgtttctgaacaacatcaagaattttcaaggtgaagtcaaaggtgaaatttgtttccgtgggataaaaattccctagtttcaaaaagtaaggccctcaagagaatgagaagacaagtcaaagactaggagaaatatctgcaaaagccatatctgataaaggacttttatccaaaatatacaaagaattcataagactaaacaataagacaacaaacaacccaatttaaaaatgggcaaaagttctaaacaaatacctcaccaaagaagatatgcaggtagcaaataataagcatataaaaagatgctcaacatcatatgtcattagggaaatgcaaataagacagtccaccttagaatgaccacattagaatggccaagatccaaaacactgacaatacttaatgccggtgaggatgtggaacaacagcaactctcgttcactgtggtggggacgcaaaatagtacagccactacagaagacagtttggcagtttcttacaaaactagacatactttacaatatgatccagcaatcatactccttggtatttacccaaataagctgaaaacttttgtccacacagaaacctacacatggctgtttatagcagctttattcataattgctaaaacttggaagcaaccaagatgcccttcagtaactgacagagaaactgcagtggaaccatacaatgaaatattatccagcactaaaaagcaatgagctctcaagagatggaggagccttaaatccatattactaagtgaaagaagccaactggaaaaggctacatactgtatgggaactctgtagattcagttcagttttgctatgaacctaaaactactctaaaatataaagtttatttttctaaaaaaaagtaaggaccttgaatcaaaactgacatgaattactatacaagagcaagaaaattgaagtcagcaaaaacccaccaatggaaaactaattaaataaattaaaatttttcatagattgaagtactctatggccattacaaataatgaagtaaaagcctaataacagaaacattttcagcatacagttacatacaaaaatgtataacagtttgaagagtatgataccatttttgtaaaaaatatgcaaatatagatagaatatacacaggaaggattatcctaagatgctatgcagctaccttctagtgatgctgaaagttggggtttactttgctttcttttcttgacctgtattttctaaattatctttaatgaccacttgtcacttttttcaacatctttattgatatataattggatatcttaaaattcacctatttaaagcaaacaattcagtggtttataatatattcagagttatacaaccatcaccacaatctaagtttagaccactttcatcaccccccacaccaataccctgtacctattagcagtcactcccctttccccccacccaccccgaggcaaccacgagtccactttttgtctctatgcacttgcctcacctggatatttcatataaatggattcatataatatgtggtcttttgcaactggcttctttcactttagcatatgttcaaggttcatacatgtagcatatatcagtagtttattcctttttattgcaaaataatattccatcatatggatataccatagtttattcatcatttgatgaacatttaagttgtttctactttttggacattacaaataaagctgccatcaacattaatgtacataggtctttatgtggacatatgttttcatttctcttaaatataggggtggaattgctgggtcatatggtaactatgtttaacattttgggaaagtgtccatggatcacttttataaaaataaaaaaagttataagaatgaaagcagaggcctcttggcctcactagactagttctcaagccttcttaagtctaatttgccaagcctaatttgccacttcacccgaaaaggatgtttaaagaggccactgatttaaaagctctgtgtcaacatgcatgcccagcttattcaagttggaaggggtcagggtggacctctagtccagtggctgctaggcctggctgaattttttacatgcagttccctaatctccaccccgaagacccactgactttgagtctcgatctcagctcactgcagcctcaacctcccaggctcaagtgagcctcccactacagcccctctgagtcgctgggaatacaggcacacaccaccatgcccagctaatttttatttttttaatgtagagagacaaggtctcactatgttgcccaggctggttttgaactcctgggcttaaacagtcctcccacttcagcctcccaaagagctgggattacaggcataagccagccagccagaatgtgaatttttaataagtcctcaggtgattctgaggactagcaaggtttgggaaccactgcgctagtccttcctgcctaaaacatcactcctaattagtggtaatggaacatccaagtcacaccagcatctgggagttgacagtcctaggccccagccacttcctctgctaaagagttccacatacactctccaattagacctagtttttcccttacaatcaacaaaaacagtctacttccttcctcataagtcagcccttcaaagatatgaggaagccagctacctgattacccttgttttttcctcctccaagataaacatgtccaattgtttcccaccatttccaggtgtctcccgcatcactgtcactttcacctgtaccctagagtctgctgatgtttctcatcaaatatggtggtcatggtggaacctaagactctaagtcagccagcactggactgaagaaaacagggagaagtccttcatgcatgtgttttcataaatttggtcaaagatatctgttctaagcagtgctaacctcatattatccaattatttattcaatcaatgtttgttaaaaacctgcaacacaaaaggaactaatgtggatccagaaaccatgaatataaggaatggctggtccctgactcaaggagtttgcatagcaatttgataacttcagtaattcctaggtaaggtgaaatgtggttgtttcaaaaggaggggagagcaaagccagctgatagtcttatagatggccccacaaagctggtggcattagggttgggctggaaatgacgagcaactgcctcaaaagtgaagatctgaggtggagcagggtctcagcagagagtgagcaaccagaaagaaacatgggctgtgatctggaaatgttcactgggtcacagcccagagcacttggagggaagcagtagagacattcttggcctgtattaactctttttcattggaattgctgtcaaatcaggtatgcttcattctatattattgactttttggagcttaaatacaatttgttgatacttaaatgtattcctattacattttattgggctggtttttgtccaacattcatatactaagaagtaacagattggaaggggtttaagaagtcagggaaacctactcaaaaaagaaagtggattagatcagtaattttcaaggttttttttttttaattagtaggatgcttcctataggcatcaactataatctaatttagaaacaacatgtaaaaacagatacattcagaaaaggcggctctggttgacactggcatgggtgggtggtccagagtcttccccactctcagacctgccctggccttcttccccctcgcccaactagaatgctttatgtggagcccaagagcatccatgttcttattcttagatcccaagggccacccaaggtattctgtggcctcccagaatcaggtctcttcaggtccaccaccttctagatcactgcacaagcccctgaaaaagatgtgaaacaggccaaggcacaggatggcatcagaaagctcatgaagacagacctcctcccaatgaaagcacatcgttgccaagtgcggcctctcaatcagttatacaccacccataggcccttcctttttatttagttgtattaaaagccttggccaggtgaatttcaaagaacatatttcaaggagtggtagtgagtgaacacataactacaagaacaccccccaaccttttatgctcactgatttaatatacttcagttctctctggagaaccatttgccctctcttcatctgtggctctcaaactatgcattttaagctcttttagggggccacatggaaagcataagaaatgggggcagcccccaggagcaaggaccagctcctggataactgcctgcaagaaaacaaggacctcagacctgcaaccacaaggccaacaacctaagtgagcttggaagtggattcttccccaccaaaacctctaataaggcacacagctctgctgacatcccatttcagtgttttgagaccctaagcagcagacgacccagttcagcccacctggatttctggcccacagaaactgtaagataataagtaggtggttgtgtgtgtgtgtgtgtgtgtgtgtgtgtgtgtgtgtttaaagctgttatagaattatctcccacttttttatctcaaacacattgggaaaacctaaagatatagcccctgttatcacattgagcccttaacttgccacaggatgcataaacattatttttgggcatgttgtgagggtgtttctggaaaagattagcatttgaatgggtcaactgagtagaccagatggccctccccagtgtgggtggacaccatccagtcattgaggacctgaacagaacaaagggtggaggaaggctgaattaacaccgcctgactgcttgaacaggaacgtccatcttctgcccttgttgctcctggttctcagggcttgggacctggactggagtccacaccatcagctgctagctctcaggcctctgaaccataccactggctttcctgggtctccagcttgcagatagcagactgtgggactcctcagcctccataatcacatgagccaaaaccttataataaatctctgtgtgtgtgtgtgtgtgtgtgtgtgtgtgcgcgcgcgcgtgcgcgcacgcgcacatgtgcatgtgtatgtgtataatctcctactggttctgttttactggagaaccctaatacacttctttcttgttgttctgtggcatacactgaatattttaaaccgcatttgtcacaggattttgaaaacgtgatcatttgtttcatcctctcttcctctgcagcaagaatcaaaattcactttgccccatgatcttcaccagaacggcatacttgcctctcccctcgtcagattgaaaaggttcctatgatttagggtcttccagcacccctcaggaagcttgacaatgaagaggaattattgatgaatgtggaaaggccagggggtgcacattcatttttaatgactacacaccttcccttgactaaatggaatcaatccttcctgcctgaatttcatccattcatcatgctctcacagtggctgacacacagtaggaactcaatatttatttgttggataaatttttaaaaagatataacttacttgtatcactaaattttgtatatgaagtgaaatatggctgtctgagaaaataggacaattgagtttatggaagaaaaaagtgcagataaagattaaaggtcaaatacttccttttgtcatctcattatccaaaccgtcaacaagtccagtcttcttgaaaatacctctaggagcatcctgccttgctagtccccctcagtggcacattctgttggctgccaaagccaacagcccctcgatggcccagggcttcttcctcactgacaccccccaggcctggacaaccatgactcttgacaagtggcatgggtctgtgactcagtcctggccaatgagacctgaggaaatctctgttgtgggtttctgggaaagcttttacttgctaataaaaagggacgtgtggcaggaaaaaactgccccgttcttcacggttgtcatcacatttgcatgagacacctagaattgccacagtcaccttgtgaggaggatcataaggagagccctgcagacaggctgaggatgagtacagaaagatggcaacatctggatccctggtggcatctttaagctgttgacaaagctgactctgcaacctccccaccttgctctagacttcctgctcaatgagatgagatgaacacccctacggcttaagccacttttagttggatttcctgctatgaacggtggaaagcaacccaactgatacccatgaccaccacccttattctatttccctgggcttctgttggcctttcccccattctggccctttctccagggccaattgtcccagtgtacagctctctgatgaaaatcccactatggctcccttcaacccattgcaaaaatccaggcccttgcctcacccacacggtcttccccagacttttcacatgcaaacatactgtcaaggacaccctacagggcaaccctggagagacgtccatgcatgttatatccattttctagggggggctataacaaatgaccacaaaattggtggattacaacaatagaaatttctcacagttctggaagccagaagttcaaaatcagtatcactgggtcaaaagtcaaggttataacaggcccatgctccttttggaggctagggggagaatccgctcattgtttttttccagcactagtggctgctggcatttcttgtcttgtggcctcactactccaatcttcaaagcattttcaactctctactctgccttcacctctatgtgtataaaatctccctctgcctctctgttacacagatgcatacccacctctgtgtgcacactcacctctgtgtgtacaccacctcctctctggaaggagctttctctgtgaaaggggaactagggaattgagggtcagaggagagaggaggattcagtctttactatatacacatttgcactgtaagcattttgtttaaaattattataaagcctccaataacttttatctcgatttgcaatgtaatattcctcaatgggacttttttacacatgctcttaggtcaggttccctataaggagaccctaaaacaagtattcacgtgcaagtaacttattaaggatgtgctgccagtgagggagcgggagaagtcgtacaacagagtagaagcagcccaggaaggacacaattttaagaacatcccgtgaccagcggctcagtctgatcctgtggggagctctgaggggtgagttatgctcagagttgtccccatctgaggccagggagcagggctttcatacacccacactcctctgtcatcgacgaggaccacctcggagcacttgtggctcttgttgcttaaagcagggcaggctcctggagctcaggagcagggctttgctaagaggcacaagtgctgcctgtttgaggtgaaagcatgatggtaaaaaggaagccgaggcatctagatcactgacattatccataatcagaggcgtctaggagatcacccacattatctattattgaaggcatctaggagatcatccacattatccaatatgtgttctaattataaaaaaaaattaatagatgtgccttctcttccagctggcctctgctcctgtcacttcccacagcaggaagcccccacactcaattcccttagcccatccaagtcctggcttgacttgccaatacccagctggagcccactgtgtccaggaggccttgttcagtctctgctctctcccagggcacttctggtcagcagggcacaattagccttgaatgccttcccatttcctttgtaggatgtcttcttcccgaggctccttgatgtgtggggcctcagcaaatgcccctttgcatccttgttcctgggcatcaaaaagtagtcactctctttgagcctatggagtttcccagttccctgagggttctgttatggaacccctaatcaccatctcaagtggttctttctcattttttatgtactctttcatggattaagtccagcccacctgccccactgggaagcaggaggactggttttggtccaatagcccatcatctctgtgtcctgccactgccacaatccacacacatttcagaacacccgagcaagtggctgctgccaaggaggaggcagagggaaaattctggctaaaagaggtaaaagagggacagacagccatcccaggctccactatccaaggacagggtcaaagtttcagatcagaagtcaggactcaataatcagatcatggccttttggggtcactatttctaaatgtaatctcttccccatcattatgggaagggaaatgacttacctgggcaacacaaactgtataaactaagcttttctctgtgacgttcctaacagcagaagagtactagcggccatctccagagacaagaagaaaaagaatttcagaggctcagaggaaagttcaatatggccccatggcaagaaatacaggcatgctggctccaggtggacttgtcaccctaagataaaagttggaggcaactaaggaaaaccactgtggctgtagagatggatgagtgtgaatttataaggacagaagggggtacctgagcctccagggatggtgacaaaagtaaggcaaacccaaaagaggaggaatgttgagcctggaatgagctgaggtgtgcaggtggcgtgaggtatacacacatgcacctcagcctagaatgagatgaggtatgtgaactacgtatgtgcatgtgtgcacacgtatacacatacgccatttaaaatcatgctcaaagcaagaagttgcacaagaaaagggtatgttcaagacaataaaaatgggattattcaactcctattttacttgcttttctacaaggagacaaatttggctaaagtctaagagactgtgaagttttctccccattaatggcatcacagcatttgtatctgattcatcaggattctcctgagaaagagaatcagtaggctatcttgtatctagaaagattcattttgaggaactggcttacatgactgtggaggatgtaaaatccaaagtttgcagggtagcccagcaggctggatattccagcaggagtcgatgttgcagttttgagtctgcaggctgaattccttcctcttccgggatctcaatcttttttcttaaggccttcaactgattgaagtccactcacattaggaagggtaatgtgctttactcttctactgagtggaatgttaatcacatctaaaaatactttcatagcaacatctagattggtgtttgatcaagtaagtgagtactatagcccaacaaagctgacataaaattaaccatcacaggacaattctgcaacttaattttctcgtttaacatttcctgtaattccttccatgtcagcttatacagaatgacctcatctataataagaatatattatcctttgtttaaccattcccctactgatggacatgaacattattaccttttttgatattacaagtaatgctgagataatatccttgtctatgccttcttgtgaacacatgcatttgtttctttagaagagatggacatgaagtatgaaattgctgagtcatggatgggcgtgggcatttcaaattgttaacagatgttagcagtttgccctctgaagcaaacttgaaaattttaaatgagctcaagctgagatgaatcactttttttttttttttaaaggaaaaggcactcatccatacatactattctgtaaacaggtgtgtaactgtcaaggtgagtggcacacaagaatttgataaaagtcaaagtactgaaggcgctgctaaagtagatctgaggctattctgacttcctcgttactcacctgtgctatgatttgctttgcagtgggaaaggatggagatgcagcctgggaggggtttgggtgttgattcctgggcctttcatgggagtgattattcacaggaaaatcatccctatcacaggaaaaaggcagagaactgctgtctttggcactaaagactatgatctcagaaccaaagtaattatcttggagaaactgtggcaatagaagaaaaaagccagatggtttaaaaagaacaaatattggctcccttgtgaattctagaaaccatagaaattgatgttactccctggcaaatcctagagtggattcttaaagagatggttgggagcctttgaaagcaaaagcttgagccccagaaacctgcagaacttcatgaagaacaagtgagacctaatgtgttattacacaggattcacaggattatgagacagggttacaggccagagtaggtttcagttacagaaaagtgtgtcatcgagcctttcatgtaaatacaatagaggaatggaagatggaacaacagggccacctgaatccactgcagaatggtttgggttagtgtcaggcactggtggagagattcctgcagcgcgccaaggactgtgtccttgatccagtctgtttgccattgagaccagtcaggagcctccatacatatgaagccttcagggaagccaaggctggaagatccccagaatgaaggatgatatatccatgatcagaaatgtcttgacaggctggggaaatgggcagaagcgaatagtatgaaataaaatgggggttaactcaacaaaagattgaatacgcaggcagagagtggagaagagctgactccagagcctcatgacaaagtctgcggggttgcagaggctgtaatgataccctaagccattctacctgaggctgtacttgcagaaatacaagtccaccctgacagaagtcaagtcctcgcaggtagcagctgctttctaggatgctcatgcccttctgacctcaccaactgagcacttcaggggtaagctgtatataagttagacccattatcctaattacatgtcttaatttaaatgatttaaaagcatataaactataagtgcaaaaacaagttgtttctcaaaaaactaagttgaattccttgaatagactcagcaaagaacaatcactaaaaagtaacaactggctgaattaggggtgtgttgggtgaggggactagaaagactagaaaaaaaaatcatgaaaacatggattctgcagtcagattccattgatattttaaagaaactgacactgggcattgtagccagcacactttgggtgtggtttatatgagaaagatgaggcagaactctacttcagcagacactcaactcaaaaagactggcaaatggacatgtatttacatactttacattcaaataaaatgtgtaagataggaatctgatttgctttgggtctctttaattggctttttcaattaacccaccagccaccataccaattgcatcagctgtaagtgctttttctactctcttatgttccattctggcaccaaatttcacgataagcactgatatgctagaacatattccagggagagggataaacatggaaaaggctctatggctcaggtagcacctggtggtgtctataagctctgatgggctgtcaggctcaaagataaacagattcagagggaagaagagggtctctgtatcttgctctttacctattcatctatgtagttttttcctttcctttccaagaattaccctttctgctcacatactagactgtaaactcaaagaaagtaaacaaaatacctgttataaatgccctatggatagacatttatcttacaaatgcctttaattttaggctgtaggtttccaaccgagcaaaatgcaattatttgtatttgactctacaggttccctagcccaacctcctctgtgcttttagcataaaacgaaggcaatggggggaggatctgtctcactgatgataccaggtgactgacacagaaagcagtatgtagtgagggcttactatgtgcccagtcctacattcacaactttttaatatattttctcttttaattctcatcaattttgagaggttgttaccagtatccccatttatacaactgaaaatagaaaaagcaggtgtggtttacttttcacatagtctgtcactcagcttggaatcagagaggcaggatgcacactcaggccagactctggaatctccgctgtcttgccaacgtgctgcactgtccgcacactacattttcgtgtgtccatgcacgtgaagagagagggaagccagcgagacagggtggaattggaatggcacatctacacagagctgagggatcagcacaggaggaggaaagaggcaggaaagggacagaccagtccccactgtgagacatgagaaagagctgggcagggacgttttgtggtcggagagctagagattataggcctgcctgggaggacagtggttaccagaaaagcagagttaactagaagccaaaagggacctgctcaggccttaaaaaggaaaaatctttcccagaggccaaaagggtggggaaaagaagtagctgggtctcaagggtagaagacgtgagagctggaaaaatgcccccagccttagagaggggcaggcaggagaggggctgtctgcaggcccaagtcagggtctgacggagcctcttcaaagagctgaggtgcgggggaacctgtcccggactggacattgctgggctgtgctggttacagagctgtctacacttagttcccctaagacagggattctcaaggtggggttcccacaccagcagcagcagctcacttgaaaatgttttagaaatgaaaattcttgggccccatctcagagccaccgttaaagactaaatgttttctatcctcccacaatgcgtatgttgaggctccaagccctagtttggctgtatttggagatggggcctctacagaagtaattaaggttaaatgaagtcatacgcatgggaccctgattgaacaggattagtgtccttataagaagagacaccagagtagccccctcccacctgtgcgtgctcagaggcaagggcatatgaggatacagtgagaaggaagccatctgcaagccaggaagagagccctcaccagaaaccaaaccctcccagaaccttgatcttggacttttcagcctccagaactgagaggaaagaaatttctgtcgtttaatccgtctagtctggtattttgttatggcagcccaagcagactaagacatccattgaataggaaataggggtagagcctggatagctgtgttttaaaaagttctccaggtgattctgatacaagctcaattttgagaaacactagtctaccttgggctgaaccaaaaagccttcaacccaatcagcaagcatttactggagtgccttggagaacaaagatgaatattcccagaccaagaaactcacaacggagggaggaaagtggacaaataacaaggatagagtacaacaggagctgtgatagggtcatgcccagagagttatgagaacacagaggaggggtctttcaccctgcaggaggtgacctaagagctgactcctgaaggttgtttccaccagctgcaaagaggaaaagaaacccataaaccaaggagttacagtcttcccacaagatctctcctccatctgctttcaggagatgtcaatctcagaggctgcgttagcctgactgcgtggagcagaaacttgagacagcactgggcagtaagcctgaaggtactgaggatgcccaagtcacctcctttgacacagttctgtcccccaggcattgacactccaggcctctgatgggagcagcagccttgatgatctcagaaatgccttcaggtcttcctttcgttgtcttggtgaatagcatatggcatccttccaccagcaccaatctccctatcaaacagtagcctggccaaccttggttttgtcttctgaatacactttctcattcttgacaacgaagccaggctgagaattttcacaatctttaagctctgcttcccttttgattacaaactccattttcagtttgtttctctcttcctgcattttactatcaacagccaagaacagctacactgcaccctgaacactttgcttagtgatttcttccaccaaatatcctagttcgtccctctttggttctgccttccacaaagcgctaggacacgaacacaatttagccaagttctttgccactttataataaggatggcctttcctccagtttccaataccttgttcctcatttccatctaagacctcatcagaatggcctttactgtccatatttctatgaacattctgatcatgactacttagataatttccgataagtctgaggccctctctacagctctcctcttcttctgagccctcaacagaatcaccctaacactccattcacagaaatctaggctctttctagcctgtatgtccaaactcttccagcgtctacccattaccctgttccaaagtcatttctacactttcaagtatttgttatagcaacaaccccacttcttggtaccaatttctgtctcagtccattcctactcctataacaatgtaccacaggctgggtaatttataaataatagaaacttattcctcacatttctggaggctggcaagtccaagatcaggcatcttgacactgaccaacaggtttaatgtctggcaaaggcccattcctcatagatggtgccatgtaggtgtccttgcatgatgaaaggtggaaggccaaaaaaggggaggcagtggtctgcagcctctcttctaagggcattcatcctatccatgagggtggagcctttgcagcctcatcactcctggggtcccacctttcaaatccatcaccttgtggggtacagttcccacatgggagtggcatctatacccgccctggttcttaaaatggagtgagcctcagaatctcctgcagggcctgctaaaacgcagactgccaggccccacccccggagggttcagcagatctggagtggggcccaagaatctgcatttctaataacttcccacatgatgctgaggctactggtcctgcagtcacattaatttttaagaaccattttatagatgattttggatcactgccatcaagtcatcctttttgaggaaccacagagccctcccttaacagccattttaatatacagacagcaggaatttcacacacatccccatggcctgccaatcactcggcacaggcacatgttttgggtgcagccatgcatcgctactgttacagccaaatgttacggagcaaactgaatgccggctgctcagtccttcagatcctcaactcttggcatttcatatttcaccaccacctggagccttcactccaccacacgtgatgggccatgtgacctgcccagcttacaagttgaggaaggacagggtcctgagaggtgacaggacctgcccacactcgcttggcatcttggactgagctttacttcctctgcatcccatttctagttaggagcatggaccctggagagaccatgggcagcagggtcacacaggagtaactggtggggctgatctcacaccaggctgtcacctggttcctgacttccctcaggacttctggcccctacgctaaccagccccggatgctgtgactttccaactcctgcttctgacgactccagttcctttgggtactccattgctatcacacttgcaagcagttatttctcatccctgttcagacgcaggtatgccccccaacagccttgctcctcacttcacgtgtgctgggaactgctgcagcttcaaagctgagtaatagtgtcccgggggacatccaactcaccccccaccatcccatctccacttcaataaccaggcaagggactgcctcaaggctgcagttctggcaggcacaagggtgtggcaagcactggctgtctagagggtcccagtgccccacactcctcacaaagggttgtatccacctctgtcttccctcggcctggagagccctctttggcagaggccctcccagcaatgccaatcctgtgttcttccaaagcattcagaaagcagttctctatgtccatggctgggcacggtggctcacgctgtaatcccagcacttcaacaggccaaggcaggcagatcacttgaggtcaggagtttgagaccagcctggccaacgtggtgaaaccctgtctttactaaaaatacaaaaattagctgggtgtggtggcgggtgcctgtagtcccagctactctggaggctgaggcaggagaatcgcttgaacccaggaggcagaggttgcagtgagccaagatcgcgccactgcactccagcctgggcgacagagcaagatgccatctcaaaaaaaaaaaaaacaaaaaaacaaacaaacaaacaaacaaaaaaaaccaagaattcagttctctatgtccaaatagcttctccctttatatcccagacactgtgtgtacaagagactaggctaaaaagtccatgcttccgcagttagagaaatgcccttcagctacccactagtgaatcttggaagtaaattagctcctccaaagtcccagcagaacgtggtttgaggaattccccttcccacagcaatttggtggcctcatgagtcaacatttctcaaagacattcttcagtatttaatgtgtaatcttggaccagggacctaacctctctgtgcctcagtttcctcatctatataatgggcaataacagtatttacttaaaaggcttattgtgcagattaagtgagctcatgtgcataactctaaggatagctgcagagggagccacagggtctggctccaatattgatgctgctctgagtattaacggaggccacaaactatgtggcctcatttatatcacttagagttgtcagttatatgcaaattaatggaagacaactctccttccaccaaatggccaggcacatgcaatgtgcttttcttgcagaaagggaagagcggggcccacccctacctgggggtgggaaaagaggggaatgaaaagactaaggggatccttctaggacctaccaggtcaactccctctcagaagaaagccacagctgagccacagccccacggtcagatcaagcaggcggataaaacaagtgctgtctaaacaaaagaagcggggctgccaaccccacacttacttccaggactgtccattgttcaaccacaatagcatcatagccctgtatggttttgctatcttctgtggaaacagcttcaaagatgaatactccatctgtcaagccatgtaaggaatctgtggaaaaagaaaaaggcgggggtggggggggtctgtaaaccgtctgtggcagaagtcttctaagcagcaaacatttccactgcattcattaataatcccaatcagaacatcttttcagcatgttaattaaagaaggcacacacaagccatagagtctatctagccctatcagaatgaatgaggctaatttacctcacagttttgaataatatccttgattttatgagcccaaatttcattgttagcaatcaccatttgatttcacacgtttaccttccttttcatgctccagcgtcaggatgcactggggagaacttatccagggtaaaacacagtcatttagagacagtttttagaagcaaactatatttaggtgagggttttttttttcttttttctttttttttaaagggaagagatataacacaccagatctgagcttgtcagatgcgttgatttttggaagttcacatgatgtgggctgcagtccagacaacatcttaggcagctcttgtcaagaggtggaatgtgggggagagggaattttcccaaataatttaccactggaaatgtttccctgggtgctgctctagtcaatgtaccaggttctgagctctgcacaattcgacaagtatacatgaaatgtatagcatgatcaagaactatcttaggcaatgagggtaaaaagaaatatagaacaggccaggcgcagtggctcacacctgtaatcccagcactttgggagccaaggcaggaggattcactgagctcaggagttcgagaccagcctgggcaacacaatgaaactctatctatactaaaatacaaaaaattagctgggcgtggcagggtatggctgtaatcccagctacttgggaggctgaggcaggagaatcgcttgaaccggggaggtggaggttgcagtgagccgagatagcaccactgtacttcagcctgggtgacagagcgagattctgtctccaaaaaaaaaaaaaaaaaaaagaaatactgaacagagtccttgaccctatagaatacactaagggaagcaccttttgcccctttgtttggggcatggctcctaaatgtcctaggttcattttgataagggatttgggggaagaagactgacttagaagcaagtggtttgaagctaggctctatcatgaaaggtgatgtgactctttcaagggctaggtctctcatctatgggattatggacaatctctcttggttcccagacttgatgctataaacactgctcaatcataatattatggactgaattgtttcctcccaaaattcgtatgttgaagccctaacccacaatgtgactatatttggagacagagcctttaggaaggtaattaaggttaaatgaggtcctagtcctcctttaactagggtaggatggggccttagtctaataggactggtgtccttattagaagaggaagagaaaccagagccctctctctccctttcctggcgtgtgtaaagaggaaaagccacgtgaggacacagcaggaaggtggctgtctgcaagccaggaagagagccctagccagaaactgaagttgtgggaaccttgaccatggacttctatcctccagaactgagagaaaataagtgtctgttgtttaagccacgcagtgtgtggtattttgttatgacagtcctagtaaacatacaaacaaagcgcatttcaatgatacgctcttttaaaaggacaatttttaatagggcaaatccataataatgtgaccttttttttttcatggggagggaagggagacaaattcagaaagtcccctgaatcatgctggagttcctggaactgccagtattttctagaagtcacaaagaaaaagactgacaaatgtgaatatataacaatctttagctttggctcccaagagaccccataaacaaaaggtcatcagcatgagaaaattatttgcaacaacaataacaaaaataaaggctaagcttaatatttttatatataaaaagcttttatagttaaaaatactgaaacaccattagaaacaaaggacataaagcaattaattaattctctttatctttccatggccagtaaacattgaaaaaaattgcagtttctttttttttttgtttgaggtagggtctcactctgtctcttagactggagtgccatggcacaatcacggctcactgcagcctcaacctcctgggctcaagtgatcctcccaccacagcctcccgagtagctgggaccacaggcacatgccaccaccccagctaattttttattatttgtagagatgcggtctcactatgtttctcaggctagtttcggactgctggactcccaaagtgctggaattacaggcaagagccaccgttccaggcctcaacttcttttttatttagcaaggtgacaaattttgaaaagaaaattttcactgctggtaaaggtatggtgatatgcaaaagtttacagtgcttaagggaattttaactgtacaatctttatagaaagcaatttaacaatgttgcaggagcttgccacaaaaagtccaccctctttcacccagaaatcttacctttcttgtctatcatgaggtaataacctccaatgccatcaaatacccatctacaagcattacttataaaattacttaaaaacttaatctaaatgttcaacaatccaaatatttaaccatagaaaaatagttaaatttggagatttctataaaatactagcctgtccctaaaaatattatgggaatttaatgatttggaaaaatgctttagatacaatattatggagaaaaaactaggatataaaactgccacatgagctcaatatggatttttatgttaaaatggtttagacaaactttaaggaaatacacaaaatgctagcagcagttataagtggtagaattacatataatttgagttttcttttatatccttttctgtgaggttattaacaagttaatacaggtataacacaagtaaatggacaacacaaatgacaaagaatttcctttttctctcctctacaaggctcttgaaggcctaactagaatcaaagagttttttaaaactatggggagatgattttagtgtaatctaaatagaaaaacttcccttagaggagtctaaaaatggcatatagggcctcagaagggtgagtgacatgttactggagttcaagtgcactgaataaccttccagccattcattatgacacctactgggaatctattatgtgccaagtagtcctgtagtcactagagatctcacaagcagcaagataaagtccctgcctacatgaagcttaccttgcagtggaggaggaagacaataacatcatgtcagaggtgatacatgctagaaaaatactaagtgggccaaggggagagtgtgaaggtggacacagtggtggtggctatttttgaaagaggcatcagggtagggctccccacttcgagtgaactaagcaagcaaggaacatggatctgcagggtttgagagttccaggaggaagggacagccagcctgacatgcagagtgaacgaaggacagccaaggaccaggtgagcagcagaatcaggagagaaggtggttaagactaaattgactggtggggaggccagccacttagggctctgttcatctgacttgcttggccaatgggatattagcaggtgtaatgcaagcagagacataaaaagcacgtgtgtggttgaacttggcctcttgtgtcttggccattacattgagagggcatgccccagttagccagttggttctagggagatgaaggacaaatggagcagagctgccgcagtggagcccagctgagaccagttctgcctcaacagagctgctccagccaaccccaaaatctgccagagtaaattgttaccattgtaagccaatgagttctgaagtggtttgttacacagaattattggagcaatagctgactgacacaatgcacaacctagacctaaaaacaagaccactgtactttgcttagcttgggtcctcattccagaataataggaaggcctaaccggttcaacaaaccatggctgtaaggtaataagcacagcagccttatcctgatattatcccaacataagatagttctccatttcaagtaagagccctatgggtaaaccaataacacactccaacttcttgtttcccatcctgagagtctgttatcaaacagccttggcagatgctaagcttgcctctctcatctgctttgctgaaatgttcctcccaagtgcttattccatggcctcctaagagacatgtttcataggttatcagggaaaaacagctgctctgcagctaaatcacatcacaagtattttggggtccaaggtgagtatggaccatagtccagcttactttttaagtcctgggtaacactccaggagtccatctggagcccctatcacaatagggatgccctaagagacccctttgagtaaagccctcccaaatcctgacctgggcatgcttgagaccagaagacactcaatgattccatcaggattgtatcaacacagcacacatttcctcaagactactacaaaaataagttatatcaaatttccaaagcctctacatacagatcttctcaatggaaaacctctaagccctttaaaagtgcctgccatgtgctttcagtacttaagtgcttaattcaacataaattatatgatggtgtttagcctgcccatggcgagcatggcagagccgaggtccagaagagggaaggggacactcacagcccatccagactttttctccatcccctgctgggcttcctctccttcctcctgagtcacaggcctgggaagggggctgtgtagtccgcagggaaagctacggctagcttgagggcatgaaggaggaacacacccagatccttattcaccacccacctcatccactgcctgcctcccagcctccccacctcagcctaatgctccagtattctgaatccagagcactgattcacctacttaaccatgaggctgaagttcagaatggctatcaaaatctggttatctgtaacagcaaaaaagtcaatgaaccagagagcagacagctgggcttttaaagagtcgcttgttttgacggccttgtccactccttgtctcctcattaccttcatggctcagcctcactataatgtgcactgaattgggtataaataggtttatcttagagtgaaggctccaatgtaaaaaggttaaactgccctccgtctatggaaaacattccattatcactgcattttttattaaagcgaagatgcttccctactgtgcacaaaaagctattttccctcgtactgtataaatatttgatgctggtcttttggcaaaaggccaccttaatattccaagcttatgatttacaagaaggatgtgggaaaaggagatttgccatattatttcaagaggtaaattctgtgaggcaaccactcttctgcagcctctgagacattaagactgtctatatcaagctaaccttcaggctcagccccagggtgctgtgcttcgccaaagtctagcctgaatgtgcatgccatgacaagcggtcaatgcatttggtctatttttgcagggttaaagacaaagtgttactgttctcctttaaacaagctagactggaccagattgtccaccctggactagctggcataacagatcctcttggctctctgagggcgccttctctccatcagaggtcgcacagcaccaccttgattccaggattcttggcaccaccttgattccaggattagcaatcgccaactgcgtaagcccaactgcacatgcaatcatatgacatgtgatcccatggcaaatgtaatcaccgctcaaccaatcccaggtaacggtgccatgttgcttcccaatcacactgcagctaatttgctctattaaccaaagaatgagcaaggctgctgccttctcttgcttcttgaacactcactgctgctctgggccggcctgccttcctacattctcaatttgaggcaatgaataatctagaaaagatattactcctcttcaggtagaaaagggttagcttgcaagttgcagcgccatttaactgaccagatagggaagaaacattctgattcagtgttagctggacgtggaagcactctgccagatgcagttcaaggcttttcattgaatcctccccaaaattctgtaagagctgtcattcccttttagtgggtagacaactgagttaaatgattagtccatgttcatgtggagttcaagggccaagccagatctgaaatgtgatttgtttcatcctaaaacctactcgttttccacagtagacattgagctactactatggtgaagcagatcctgtttgaggcaccgggggtaggtgctagacaggctaggtttctacccttgcagagctggtgttttctgaccactgcaccatactctctctgcctcggtggttagggtgagatttcagttgggtcacaatgagatgggcttagggcttctgtttggggccacatctgtgcagatgccatgctgtcctatatggggcaaaataaataaataaataaaaatatgcttgtaaatggctaagttacgtatatagctgtgtatttgacacaatggaatagcacacagcaatgagagaaaatggtcttcaattacatgtaaaaatatgaatgaatcccacaatgacaagtatataaagtctgtacagttcaaaactcatcaacagtgtttcaagtagggactgtggttactctggggggatagaaacagcgtggggcacgcaggggcttctaggggcttgttaagttctacgtcttgatctctgtgctggtgacatgggtgtgctcaccttgtgaaaagccactgagctatatcctatgatctgtacagttttttacgtgtgtgctaaactgcaataaaagtttttttaaaggtgtcctatggacacatgagaaaatgcatttaatggcatacgtgcaatttagcccctacattattaagtggcttctttgaaatagaagccctgcctgtaaccactaggccagacattcctggaggtgggtggtgtcccaagggagtggctatcagaaacacctggtactacttcattctccctctttaccagtcccaccctaaaacctgcagattcctggggaaacactccaatatcagtgttttccctcaccaccactggcattattgagcatcatccagaactatcattagccaccttctgaatacagcactgtgatgttaagaaagtacaaaaagtaggacctgcctggggggttggttgcgagtatgtctgtataaaatatataccccacatatttaatatatattttatttaaaacatgtacatgtgttttacttatgtattttgcaaatatatgatcatggaggatatgctaggtgtcaaaaaaaggtggtataaatacccatacaaagtgatacttggatttagatgcagctggggcaccggagaaagtctcaagggagacctaatcttttaaaaaggtggcagcagagagacatctgggtgtcatgtgacccctatgtgatgcagtgtggagaacacattgcctggaacgtattcttgtcataattcttaacttatcaaggccttagaactaacttccaggttacaggaaatagaggctggagatataagatcaatgacaccatgagccctgaccagatgaaaccatcatgcaggccattctgcagaataagaggctaggttcctttcaagcagtcagggaaagaaaaaagggctcttctaggcaaaaagagaagtgaggatacagtcaccgcaaacaccgactgttactggagtagattctggtttggataatcagctgcaaaggccatttctgaaacaaagaggtggaggactgccagggtaggaaagggcaagcacaggccaagggtatgaggaacgaggacaggagtgggcaggggtgtggagcagggaaggcagggcaaagagggtagttggaggcgggggacaggacagaaccagaggaatgctgggcaaggcagggcaagagagatggtggcagcggcagcagcctcagtggctggtgatggcagcagccattctgtaggcccagaggccttcgtgaaaaatcagcctcctcgctgggtcttcaggggtgggcagccttagtcttaccccaaactcctggctcccacccaactcctccacaacagctggctcagctcggggtctctcctcctggtctttcccatcctctagaaatagagaaactggccttcatctcactggccgacatgttcctgagtgcctggctgctctatatgtggcccctggactcattcttgcttccatcgggtcctgccacctccctagagtgaccttggagtcctcctcgtcccaccgggagagccgccaaagtcccgctgggggccacaactcctgccagcatagccacgtctttccttttctatcccgcccacctcatggtccttttgtctgcctacccccttctttcttcctgccaccttcttgctcttactagccagtaaccttgacaatgacataatgtctctgtgcctcagtttccacagctataacacaggcataactacctacttcactgaggtattgtgaggatgaagtcaatgctaagtttgaattactgagaccagcacccacacaaagcaaccgctaggtgtccatggtcatcactatgcccctcctctgtgccctaagcttgccagagcccacgggcagagcctcccccagcccaagacaccgggtcattctaaggtttaatgaacgacccagggagaggagtcctggacaccatgagcaggagcccaaacttgaggactgtacaagtctttctatgtcccagggtgggaggcatggggaggggagtaatgcctcaagaacagaagctctggagtctgcactgggtaattcaggctgaaacatcaccttgtttatgggacacagttctcatgagctttatgaccctgtggaaaatattttggagtataaatctctattcaggagtcgtgactagtgccattccagatggcaaacagcttaaagatgtgcttctagctctgccagctttatttgtaaggacactaattatctcactagaaataggttcctcttatgattacgattagcttgccattttttttcttaattctgggaaaagatcacacacgtatttcatccctggccaacggaaaccttggacttttccagagcagaaacgccctaacccaggaagcattactcccagtcatactctccctcccaaaagacatataaagggtgaaatggtgtttaaagtcagagtgggtttcaattcattttgttctgagaattgtgcagccctccctgacatagagatgaacagctatggtggcgctctaagatacgggctgcatacaggaagatgcctgggccctgtggaggacttcacggttgcgcttgccaggggaaatttcatgttctgtcttcagggcaggaagaatgaatttaatgtggttaaagccaagggaggctataacagtatttcaaacactcaagtcaaatctgaagaaaaagctgcttaagttgtctgcatttctggactccaggttgaagagtggggtgacgggaagtagaggaggctaactcagccttgatcaccaaaccataatggtagaggaacagcaaatgggtttgtgaacgttccaagtgttctttcttggaggtcttagggcccctgacatgctcaggcagtggggtcaaagagaaaaccttccttctgatgccctagttttcctaagaggggaagaaattccaagtggccacctgtgtatccactatctccagcacctctctgcacaccttcaacaactaaccatcagtttcctagggaggaatgtaaaactatgcatggccacagatagcatctatgggcaccgagaggggatgaaaggagccactgttgccacaacccaagatgggcaatgtggtgtccctgcaggaaacagggagccaaaggttcctccctggccttctctgacactgatatgtcaggctgtaaacatctgtcccaagttggccccaagcatgtaccgccactggtgttttatgatgcatctgaaaccagaccgtgacaacccctggctttggggaactttgtaagtacccacggagggcttccttgtgtagagggaggttacccaccttgccaccagggcacagaagtaaccctacattagttgtattaaagacacgtatattcggccgggcacagtggctcacgcctgtaatcccagcactttgggaggccaaggcgggtggatcacgaggtcagggaactgagaccatcctggctaacacagcgaaaccccatctctactaaaaatacaaaaaaattagcctgcgtggtggcgggtgcctgtaatcccagctactcgggaggctgaggcaggagaatggcatgaacctgggaggtggagcttgcagtgagccgagatcgcgccactgcattccagcactccagcctgggcgacagagcgagactctgtccaaaaaaaaaaaaggcatgtatattctagaactgcactgaccaagtacacactgaccagtgacactagccactagccacatatagttatttaaacttaatgaaagttaaatgaattttaaaattcaattattcagatgcagtatccacatttcaagtgctcagtagccgcaggcagccggtggccgccatactggacaacccaggtacagaacaaacacctccatcatcatgggcacttctattggacagccctgctctggatgtattcttaacaagccaatcacctttcttgtgtcattcatgcattcaacaaatggttatggaccactacactatacaatgcctgctgctactatgataacgtgtcaatattagtcaatgatacttagatagagactcgcatccaaaattaagagctgtctgtgctgtatcatgttctaagactttggatgatttaaagtacattcatttagaattcagaatggtctctattctcaggatgcttgctggcatttcaaggattgcaaacaatgtagaatccaaactctgttcgtgactctgttaattcttgagagaaaacagctcaacaacaacacacggcgctgttgatgccccctgccaggttttgctgggattgacaaatttggtgttatgtgtcacttaggaatcctgctgactggcagtcctcaggatacgcacgtgctggcacgttggtcccactccccaagttgcctcccagacttgacacaccctggtgactcaacttgccttctcgttaacctaaagccttttctttgtttgacacattttcccactgtgggcagactttctgccttaggagagctgacatcaatagtgctatcccatgcagcaaaccactagagacagcacattactggggagggggtactgggtgctgggagacctgggaacagtgtgtgtctcagtggagcttacagaaaccaggctgttcaatttatttctctgctgttaatttcaaggtgctgctactgctacttcaaactgtaatagtgtctacaaacaatttgcactttggaatgccacaatcccagggggtaattaacaaatccagggaacaatctttttaaaagcctttaaaagcaacagagactgaggccaccttcgatgaaatagaatcactccactttctctgtcatttcagaagatacctggctgactcgtagagaggttttgagagcacaggccctgggctttatggaaagttcctcaagatgtgttaattagaaataaaatgcagcatggttatcggctgcagagctttctgaatgaagcagactctgaagagggactaagatttcaagagttagaagcagagttcacaaagggccacccaaggactgtgaattccaaacataccattcactattccaaggtagaagactgcgttcaccagcatgcctcctttccggaagtggtcgctcatgtgctctaaccagttggcgtccaaaccgctcactgtctggccattcttggagacatggagaggaatggtgacagggtagtattgccggcacttctgatggctcttcggtttgttgaaaagggtgaagatctccatttctgttgggatttgtaaagggagtggagagagaagaggtcaactgatgataaaaatctgtttcatcggcttaagtggaatctctcaggagcctgaataaatgatatgatgaatgctgaaatctctgtgaggctgtattgttgccagataataaagcctcattccaagtaataagttgaggctggcttaaagtaacatggacctgaagggttgggcttctgatggggaacttaggtttttaatctggaatataatgaatagctgttatctgcgattaataggcacagctaggtgtttgagaaaagaacatagcagatggttctagaaattcatacaaagatgtgttttagaaataaaagcagacatacttgggtgagaatggtctttggaaaactaaatgtacagagacacataaaaacaaaaatactgctctaattccaggaaccttgtacactcctgaactcactatttataaactgcagtagtgtttcctggggctgaacccataatacttaatcaagtacatcaaaaatacatcattgatatgtaaaaataaatatgttcccgtaaatgagagttcctgcctggagtggcaggtcggtccaaacagccaagaaggcacaggggatgaggcgctgagcttttggttccttcatttatagctcagttcttcagcaatcaataatcactgccacccagcagctgagccgcaactgcctacgtgcagctgggcgtggcttagcagtagcagcctccagaagcaaatacctggaatttcaatctaagtctgagagtctatttttgtgctcctcatttagtcaagcaatcagttgacccagcttaaaaagtcttgcttacacaggctagtcaggaatatgctttggtttccaaaaatatcttcttaaatcataagaaaatccccacccttctttgaagcaagaatttaaaggtcataaacaatggttgacattagcaagaaggacaaagcacattcatgctccctgcatgaaacacctggacccacactctctgatgctgtttctcagatttcagtatctcacaatgttttgtggtatccaagtactagttgatttttttaattgactcactttcctttatttaaacaaacacatttttttagaaaaaggaaactttgtttcatgactatgaaggcagtccgctaccacttgccaaaaacaaggggtaatgatgaagcacattaacaccaaatatgttcatccatctaacatctaaaattatctcacataggtcacaaagtcttctcacagccccgcctgagcgaacaccagcagagatctctagggaccaacgctgggccatattactttgtcatcagcaatacctgaatgaacagcagccatttcaggctttccatccaatagaacaattagggaaggaaggtgcccgtctttggaagtggccacctgtattttaaacaccaattctagcctgttcatcatccccacgccaagttgcttttctcagccctcctgcttactcaggaagccatctccagccaggaagtactttcacaccagaaattaggtcttggtgtatagaactggcagtcactagactagtttgtgagttcacaatacaaactttagaaatggagcgacacagaggaggttcgtaatggagggaatccggccataaattggggctggggtgggcaggaggtgaactagatgattgggtgttttccagtcctgggtgtcaggggttcaattaaaagctgcagctaccgagggcaagaggataagcaaggttttagtgagttcttgggtttatttggattccttcgaaagcagaccctgcaagctttcctgtgcaagtagtttatttgggaagtgatcccaggaaacagagggaaggagtaggaatgggcaacaggaaggagctggagatgatgccagtgaatgagtgcactgaagagcatgttaccactggggcagctagggctcaatcccaacaaggaccctgagacactgtgtaaaacacacttcagattcacccaccaagggcaaggaaggtgggacatttatccccataaattgaaggtcactcctgaatcattaattcctcagggcccattcccgagaatggctgcaggtagagaggctaaggaagcggtgggctcggccagagctgtccacaggtgaccccaacatgggccatagcaccactcgctacagcctgctacagtcaagcacaaatgcaaatgaattaagaagaagaagaaaaaaatcacagcctctgtgtgggagaagtaggtggggaatttggaagtggccaaagtccaaaactacatggtaacacttgatcacacagaaggaactcccactcaatggcaagacagaaacataactttcccaaatgcgtaatgaaccaggaaaaggggaaggccaaaggagaagtgagaatgctgggggtgtagcggaggaagacagagaccctcagaaaaggtagacggtgctgacagctttcccggcttgatcctccccagggggccagactgaagccagagacagaaataaatttctcaggaaaaggaaacagtgttggaacgaagagcctccaaagcatcagcagcaatgaaatattgggagaaacctgattgcacatgcataacccttgtacgctcctctgccccatcatctccttgtctccagtcctttctctacccacatggaaaccagccaagagaactgtccaaaagtgatgtcctttgatgttttaatattctgattctccaacacacatcctcacgtgagcaagcaccaaagattccaaaaagaagccccacgtttgtttaaattttctcagctgctctgtgactctgccatgaccccagctggaagatttttccagacatgggatggtaagtcccaaagggatagggaaggcattgtttttgagaatgttctgggagtggctgaaggactgtactggcagagcacccaaggagcatttggactgtcttctcatctctccctttcccccaccttgcctcatttagatccctcctgttacacgtgttcaccgtattgacctaagccaaccagaggagaaagtgagggcaggttaagggggcatggggcccaagggtgggggtggctgagtcctgccagccttggagcctggtccattcaggccttgccaggctactagggagtggggaggaaagaggcagctgtccagccctgaggtctgtacctgggcgtggggactctggcacaggatggaaggctgcagtttgcctgcaggtggggccccagagagcccaggtcttgagggtaagcaggggactggctgggccctgctgtcccaggagacctctggtctggagagaagaaagagtttagagcctgggtgaaaatctggggctccaagggctagatgtgggaggaggaggcagctggtcattagctgcattggaaggaacaagtgggcatcacacttggctgggcagtccaagctgggtggggactgcaggctgctgaggtcatgggcagaaggaactaagcagaaaggtttgcattgggaagggaggcagtgggcaccatggtggcgaggcagggcaggagggtagaagggccccaggctgctccatccagatgcctaaatctgggcaaggctgctcaagcttcgctaaggcttgggtactaatagcaggtactaatagtgaggcccgcttgccagggcagcaggaaaggcaaagtgcagggaccgctgctgcgtgcacaacaatccacaggactccacctgcaagcatgacagcagccacaggcatgtgtcccatatttacaagggcctttcaccttcaccatctcatgtgactctcccaaacttgatgagagggggtggccctggttctgtgcccagaagtgctaagtggatcccccagaaatcacaagccagtaagtggcacagccaagagtctttcaaaccccaaaccctgggctctttcccaaatctaacaagaggctaacttcatcaggacacagaaggcaggggctgatgaccgtgggtgggagctcaatagctgtttgttaatggactgagtaaaaggccagaaagatggcggcaggtggcagatctgggagggggccgcatcatggggtccaactatcccaagggagttgggagggaaggagccctcacatcaggaaagcccaacccccaggttttggccattcacaatgagctggcagccagggagggctactgaataaaatcctctcagccagaaacatgattggcatcacacgcttgggtttctggctgacatttctaagcattttaagtgaggaggtgcagggtaggaagggcagtgcttggaagacttgttattttggtgacggtgagaatgattagaattttcgtgaacctgtctagcctcctggtttctctgatggaagctgtggcaacggagacactgaggctgtccctgcacaggctcaggtgatcacggcacagcacggacctccaaccaaaaggaaattcccccagaccaggaaataagtcagcgagcaggaagaggaacccacggcgggcctccccaagaacctgcaggggcaaggaggcgtgacggctgcaccgagcccgcagagatggggagggacgacctgcccctgcttccgcatggagaatccactggaaagtcctgtctgagcaggcattgcctagattcctctccccaaggcctcctataaaggaaataaattaactgaggagaaggagggaagaggagggagactccctctggattttttttaattgtcttgctgtgattgcctatttaagcccacctggcagaagaggagtaaaaaacacttcaccctcccttagggggctctgagagaaggcaagctgggagctgagcaggcagtggggaggggtgcctgggggggcccgtgtgtgcctgtgggggagtgacagtgagtgggcttcctaggagaaagattaggagagaggctgggggtcaggtgagggtcacaaccaataaggacagggtccctggacgttcagccttcagggaggccaaatactcaagctgtgataaagaaatttaactatatgggggtataaaaggtgacactccctatttgtaaaatggatctagtaatagcatcttctgccataaagctgttgtgaggagttactgagatgacacaagaaggacacagaatagggcacttggagggtgactgccatcgtgaccactgaaaggcttatatgtgaaatgatccctgtatgaaaaacccaaaagctcatctattccatcaaaggagggaaaagggataatagtgagctgcctaaatttcagagattcgcagcctgagcagagagataaagggactgctttatgtgtagagacaggcagtgtttacctgcctagggagactgggctcgaaggaggctttaatccctcctcctggcctacccgtgcagagctgaaattctcatccactggtgggctgaccacctccagaaacacacacattcacccattcctccccagcagggtctgtttctccaggagagaacagggacttgggtgatgggataggggccaagatgctttgggtgtcaatttttctgtgttcagccatcaggggagattctgggtgaggaaggtgagtggccacggggtagcaagaaggtcctgggcacctgcggaagttccttggacaagtttccccagtgaataatcctctcacaggaggcaggaagtctggaaggagtatcggaggaaggtgggctctggaacacaggaagcatctgaaagctactgaggaaacctcaatagtaactgcctcctttctcaaagccaggattccatgagaggtggaggtcgagtgtcaggactactgagcctgtaccccaataatagcagctcatactcatgagtcaaacagtgccgagtgctttaaatgtacaactttaacctttccatgagaaactatcgttctatccccatttcaaagggtgagaaactgaggcacggaaggcaggccggaatgtatactctagattcttgagcaccatgctcctcacctctccatcactcctgccctttctcctgggggcctctgcctggcctgactctcgccctcccacagtcctggaccgtacagaaggactccagtgaggtccatcttcctgcccaggattcagagcacacacatccagcccagcctccatgagaagatggaggtttctggactaagacctgggcgttcatgaggacgacacactgggcttaaatgcatgctcagctacttcatgagggcagcaggcatgtgcctcaaacagcgaaaaatcacacagatgaagggctctacttcagtgcatactaagaaggctcaatgccttgattaaacaatagtcttactacatcacaaaactgacgcagctccaatatctccctctaaatcaactttgcaaataagcccctggaattaaccatcccataattttcctctcaagaagttctgatgtaacaaaagaaactgtttctccttgttttcccttctggaagcaccacctgttcattatcacttgtaagaggctaaattcaagaattcgtaaataaatggtaataacaatattaaccagggagatcatccagaaaggcctaaacagaaagccctcctaagccctgggggtcttctgttagttttcatacttgttcttacttacatggcttatgtaagtaccttgctctcaggaaatgaccagatgctagatttcctggagaaagggggaaatatggatggttgatttcctgaagaaagtagagaaaaaggaaatacagagaaacggagggaaactttgctccctgtaaatcttattaagggcctcggcaaatcttgttagtctatcacacaggaaagaccaagcagagaggcgtgaagggatggtgggtaagtccacctgggttcatatgcccgaactgcctatttccagactgggcaacaaatttcctctctaaaccccagtttgctcagctgtaaaatgtcttgctttaggcaagtattttaacaggtggtgtgtaggttttcatcggtgcctggcaggctgacacttcctgtgtgaaaactggataattcaagggcaatttcgagagcacaggagataaaagagctcacagtctagaatccacttcaaacgtgacattttggagcaaactgcaagtcaatttcatgtggttctgaactccccagaagtcataacttcagtaagtaaacagtcaggtggcacagataactgcttgataaagtttctcctgtttgatggactgctgtctctacactctaaattccattcctttttctctgagataccatggggattaatgaaaagctgttagctgctctttaagtgggtcaaaactcccattgctgacatacttactccctgagagtggctcttcatgcacctccaaggggttgctctccggtccatccagtgtcttgctcaccccctgtggtgaaagttctccaccatctccctctccggagggtgagctgggctgcttggcgaggggcacctcccctctggggcctgagctgggctctgggctttggtttctcccagccggagcactgcacacatccccagtccccggtttctcattctccagtgacgcgtgatccccacgtgcgttttttgcatctctggcatcctcggtgctgttggcagtagacaccggagcactgctgcctgccgagttcacagaggaatggtactgaggtataacaccaacgaatttcaggccctggcttgcagcctcctggatctgtgaggcaaacaaaaggaagggaaacaagtgaatgaaatggtctatcaaagggacacgtgcagcgtgcaaagcgcctccccgaggcctgcgaggctgtttcaggtgcaggagaagaattccaagctgacaggaactccatgtcctcaggggcacctgcccccacaccctagtctgaagaagacagtttttttaatttgttttaactatattgtctgatggaaagataaagcatttggctttgaagagttgaaatcactactttgaaacactacactagtccttattaacattttttaaagaggctggaaaaagttctaaacaaagagtttgaaggaggaagtttgttttattaagagtttagttttttttgtcactttttttcggacgaatcactgacttcctgcccatcaggctactgtataactacagcttgtctatataaccatatacaaacaacagatggcattttatggcccaaagagcttcctttttggacaatagttttggcagagaagggcagaggtgggaaaatcacccctgtgccaaggctgtgggcaaatcctccctgagaggtatcatctgatggacaccttgctccctggtgctctcaggcttagggaaggtcaaaggagcccacagatcatgcccagcccacagccacagactgactcttggctctccaagtcctggtccacaccatcagcagcgaggtgatggttccttctcactccctgtaccaacgggatgggggatgaacacccacctgcagtaccgaggtacttgaactttccctctccctaaaaaatagcccaaggcaattgggttgaatgtaagtcataagtttgaaagaaaaattgaaaataaataacctaataaaataaagcaagagccagccaaagccagaaggtagcctttaggggactttccaggcaaggatgcttaagtcattttacaaataaataaggcggtgcagacctcagagctgtctaagtcttagtcaccaagctctaagcagatgacctcagaaaatcttgaggcctctgcaatgataatctaccctcatttgagagtcagttttgccagcacagaggtattctctctaaaggagaagctgccctgacagctctcctcggaagaaccaccctgacattaaatggaaagtcatttttgttccacactgcgcaacctggaaaactgcagttgcaaacatgcagtccagtctttaaatcctagcctgtgctagacataaaataagaatagtagtaattactgtctactgtagacctactatgtctaggcattgagctaggcattttacataaattaaaacaacaaaacgtttcatccttcaatgatgctgcatggtatcattgtctccatttcagatgaggacactggagcccagagacattaaagtcataaaacaagcagtgagtagccagagtgcaaaaccaggtctggcctgggccaaagttcattcttttaatcacaagactcagtggacacatgtcaaagcatcaactacatacatgtctatgggcatgtatgtgtccactcatacgccccgagttggctcaattcactcttcaaaagttaaaaaaaacaaaagacaaaaaaatcttaaagccatctattccattctgaaaattttttccctcattaatctatgatatccacctatgttaaaaattattctataaagctcctaaaagaaggcacagcaacacaaattttaaaagaaaatagcagggaaataattataccaaagaactttggaggctgaggaaagccactgcatgcaaagcatacttctgagctttctggcaacatatgccaaaagagaaaggcaatgggttttacagccctcaaatgaaatgaggagacacctgcactagcttctgctattactctcttactgcagaggaaacagctatgacttctgaagcattttaataactgcttccatggagggctcaaccataggccagtctcaactagagtcacggaaatagcatgaagtttaaaggcttttggaaaggcctgatgtggagccccagatacgtgactcaccatcttgaggaaccagagtagattatataaactttctgtgcctcagttttctcatgtataaaatgagtgaaaacacacttattttgcagttgcactgaaacttagtttagacattacatatggcaagtgcgccaaaggatggggcacaaagacggtatctctaacctctctccttatcagtcctgggcttctgcggccctgcagagactgctgtcatctagagtgaagaggcgaggactccagacacagggcattatcctagccctccccttcctcactgggactggaggaattggagaggcttggacacagacacctgcccttctcccacaacaaaccagacaaccatattcctttgccatcttgtactgcaaatttatcctctaggccaggggttctcaaagtgtgggccccagaccagagcatcagcatcccctgggaacctgttagaaatgcaaattctcaggccccaccacagacctactgagtcagaaactctgagggtgagatccagcaatctgtgtcttaacaagtcctccgagtgattccaatgcagcctgatgtttgagaatcactgctctagaatacacatttcatgagggctggggtagtttgcactgctgcatccccagtaatagaatgatgtctgacatatagcaggtcctcaataaatatctgttgaatgaatgaatatattaaataatggatgaatatgtatgccttctctcccgaaatgagctccttgaaggtagggatggagacattaatttttcagctgtagaatccaacaaatagttaataagcccctacactggtccaggccaacacggtgcttaggtaccaggaatgtaaaataggatccccaaccctcaagaagatttgaccaattattacgaacagagtttaaaaataattacactatcatggaacaattaatgcttgaaatgacatataaaaagtcaagattctaaacttcatacactttattatgacaactatgtaatacacatacataaactatgcataaaaacagtcaccaaaatgaaaacagcactgtatttggggagtggggctataagtgatttttttctattactgtgtaattttcaaaatttacttaaggggcatggatgttacttttagaattgaaaaagtaaatattgtaaaaattcctcatagaggataatatagtaatggatgtgaaggcatagacatgacagtgacaatggtgattatttctgcctgaaggggaggttgagaaaagtttctccgagtagatcagggatgtaacaaatgacgtggtgtaacacaaaaggaagaataagaaatgtggcagaactggagcatgcatgcctcaccttaaagcattcaaatccaattttttttttccaaaatgccatgctagacaaaacctatttgggacctactctgcagaaggctttgaaggatgaataagagttcagcacatatgtaaaggaaaaggagagggcaatccatgtaaaggcaaggaaggatcatgatgggcaaaagcgtgacagtatgcaacagcctggtgtgttgaggaaatttctagaaatatttctggaacatgacatgagaaaccaagaggagcccagaaatgaagcttgactagacatgacaaggaccggatcacatatggccttggatccatgcccgcaaaggctctcagttcaccctgcaggccagcatatccgactctcccaccacagtcataacctcaagagcagaggagagtgggagtctgagggaaaactgcaagatttcttcgaatgctcatcttttaccttcaacttcagcacaaattttgtatcttataccatagtgctacctaggatccaaactttaaaaagatgtcaaagttaaatgctgcccttatcctatgcattccagggaaattcacacccccaagaagaggaagcatatttgtagctctgcttatttccttcaaatagattcctggaagtagaattaatgaatgaagggatattaacttttcaaaggcttggcagaggctgccaagttgtttaccaaaaagggtgcgtagtcctttttaactagacgaccacatttagattttatgaagatcaatatttggctagatctaggggccacgactcttacagttctgtcttaccctagtatagacactttcctctttttcagaaagtcatttgaccgtgtacttatggctaaagtaaatcctgcttctcattcttgcatttataacctttactgagccagtctcacattcatcatggtggtgggcatgcgatgtattcatcagggttcatccccggctgccagctctcctccactctacactccccttggtgacttcctctactcacatgggtttagctacaaatcagatgttcattattcctaagtgtgaacccctagccctggctttccttgcaagttcagacctacacagaagacgatcacagctgacgggtccactgttgatctggtctcaccagctggaatcacagtatcttcttccctgtttctaatcctgtgtgtctgttcaccacaccctaccacatttatcccccagtgtttctggaattacttcctccttctccataaagtgaccatccaagctcactttatttcaagccctcatcatctgttgctggacatcaccatgacctcaggcgatgccagggtcttcatgagcatggaaccaaatcaacatggaagaacaggtcatgaggagccaggtcacctcagccatggagctccccacagactcccacgcatgcccacaacatctctaacaacagcgattacaggaaacagcaactattaacattgcacagctcttctacaaagaactttcacatgcattcccttaggcctcaaaatcataccttacagaagagaaaactgcttaagacattctgtgactggtcaaacctcacagaactacccaaagccatgcctggctttcgctctgagtatcctaagcccaacctgatgcctcttcaacgataccactctttccacttcagataatctgacctgtgccaagatgcccaggtggatgcctgtttaaactgatatacaccctcacccaccttattctcatttctgctgcctgtaagaacccacctgccccaaatacttaaagagtaacaatttctggttgaggcactgaaaattaaacatggctgttttgactaatccacaacttcactcagttgctctataataagtaaggacatgctccactgtaactataatcaggaatcatgatgtgaaaaatatttctttttaaaaaaatgtagttatataaaaagtcacaagtcattgtaaaaaaaatctttggttatatatttgaggaattatttttattaaaaataatatgacattagatttctaggatggattgtctgtttctatgtccaaaatgaataccatgttgctaatgataagtgcgatatatactctatgtgcatgcgaatatacgtatttgtgatttagagtatgtgtatcaatcggggtgagaaatcagaaagaagtgagacacaggttggatttcataaaaatgaaggctatatggaacataggaaaaggaagagaaaagcctcctgctcacaggtcaatagggattggagtgtccacagcctgtagtagatagcatgggtaaagagtcagagacacttccaagactgttttgtctgactctaaggaggatggtgtcacagttaattttatgtccacttgactgaactatggtgaccaattgtttggtaaaactctagtctagatgttgctgtaaaggtattttttaaatgtgtgattaacatttactatcagttgactttcggtaaagtggattcctccattattaggtgggtctcatctaatcaggtgaaggctttaagagccaagactgagatttcccaaaggaaaaagaattctgcctctggactgcaacacagaaattctccctgggttttctccccttcaaactcaaagactgcaacaccagtccttacctgaatgtccagtctgctggactgccctgcagatgtcagacttgttggcccccactatcacatgagccagttccttaaaataatcaattttctctcttcccaccaggaggtaggggaaaataagatagcacagggcaagttgatggaggtctctaaatctaaacctgactaggcatgaaataaaagttcggtacaggctcccaaatgacagtgagccccaaacagaaacaagacaactaggacttcatctggtatcgattccaggtcctacgtgagaggctgaagtgtggcagggaggctttcagccatcactgttgcccaggtaaaggaaatttcccccattgtgctttgaggagagctgctacacaccaggtaagggaggttgtatctataactgatggatttattttctacaagttacataataaacttaatgaaatgcctgtaactaatgagctaattaatgctgggaatcagaaacctactgctaaaaaatagagagctgtgctgtccaataggtagccactagccacatgtggctatttaaatttaaattaattcaaataaaataaaatttaaatattcctctccttagtcacatgagtcacatttcaagcacccaccagccacttgtggctagtgatgaccccatggacagtgcaggtgtagaacatatccatcatcatagaacgttctattgggtagctctgctatagagcataataaatcacataaaatactgaataatagagtttttgacagtgatttctgaggcatataatatggggtaaatccaagactcacatccacatacttatataccctagatcagaccactgcccactccggccctccctcataactcacacgcccccgatccgtgacaacatagcacagcacacgcagggagcccacagcagaggcatgccctaggtgtcaagaacaggtacaaaaatgccattctgggttgcagttacacatgagtctttacagtgaatattttatcagacacacacaacccttcccatcttgtcacctacactcttgtacagctttctgaaaagggaggctcaaaaataacacgggtttgagctcacatctgaagccgcctttagttttgacatgttaacacttagctgcagaaattggaagctttgccaggcgctgctggatgtttagctccgttttagggccacaaggaaagatcatgtaaactttctgctgttgtggttttctcatttagcgactgagaggtcttagaatctgcccttggacaaagagtttgaaggcttaaagctttggacctggctctgttactcagtagttatattattggtcaaatcagttgatttattttagcctcagtttcttaatctataaaatgaagatactaatattcatttattcattccataactacttactgaataccaattggaatcaccaagcaacccccagccattccattgcacagagtagtttgtcatagtagatgcatgccctgaccaggagggcacagtcaaagagtcaacacgctggagtagtcaggagtcacctctggcagattttccttggcccagaacatcccaatcttcctcagtgtatgcccatcagcagaattcaacatatgtgtggttgtctgcattcagaacaggattctggagcaaagacgaccttggcccatgagaactgccatcatccaagtaggaccattgaggaaaagaactggcaggagaatctgctgccccctccaaggctgcaagacccccaggcttccattaaatgctgctgcacacccacaaggaaactgataaatcaaacttcaaaatgttatgttagcaaagcatttaaagagactttcgtcatagtcctgtgggagtcaaagaatgcatgccagccttcccagtctgttagttctgtggctgtcaaaatccattattggtagccatggatttaaccttacccacaggtaaaatctgtgcatacagaaatgatttgggagaaggattcctatgagaagcagggctagcaaaagtgaagaggcaagaaagcctcagaagtcatgcagggaagagcaaatgttcagtgtgcttgagctgaaattctgtaatcacaatttactgagagcttactgtatgcccaacactgttttaaaggctgtacgtggattaactcatttaatccttataataataacaataggtattatttttcatccctatcttacagattagagaactgaggcacagagatattgggcaacttccccaaggtcagacaactagtaaagggcaagtaggattcaaacctaggcagctggctccagagcccacgttgctacctgttacgctgctcagcgctgtatttgcaatgttcctacactctaagctgtactgggaaataccagggctagattgcagagtcttgcatctttagagtctggactttttattctgaaggcaatgagatgccatcatgacttctgagcaaagtgacatgatcaggcctgtcctaaggaaaagaaatctgcccacaggatgtggtatggatcgaggtgggggttggtaacagagcgaggagacaggaggcaagggacatggctggggcccggaagtaactgcagagctcatgggaaaggtcataagagcctacacttgctatgggaaaggatgtgagaagtccacgggagacaaaaagtagaggcagcagtctgtgacacaccatgggatgctgatttgtcaaacaactgaagcaaaaagtaaaataataattacgcttagatgacaggcatgaactgggattgtctgaacaagctgggacatatggtcacctggttcagtgtgaccagcagtgaagacccagaaagctgctttaagaggcacacagatgagtgttccttctcttccttccctgtccatcacatgacccactgcttccatcactctcctcctattatatccttggctttctctgtctgacacatcccacaaatgtcgcatccatccagtccacccagggccacaaggaggagggctcaaggtctcccgccaaggctgaggccacacggccaccctgcagtggctcccttcctccctgatcagctgtcttgtgcttccccagggctttctcccctctgctgggtcccaccctctccccactttcccaccacctccagagatgacttaaagacaaaatcgaggtcagaagctgagaagcccatccccatgtcctcttctggccctccactctttgtccccagcatcggtgtgacccggttaaggcaaaacccaggccatagagctcatgttttctggcaccctggaagacccagctctacttaggaccacttctctcttctatatcctcaatttctctctctctctctctctctctctctctctctctctctctactggctccttccactcagcatacaactaaattcaagttatctttttttaaaagaagaaaaagaggaaagaatccaaccaacaatagaagtaagcaagcctcgtccacccacccgcctcaccgactccacctccactcactctctagcttctgtactgcctcctcaccggcagctccccacagccctcctgtcacctccatgacgccaaatcccacaggctttttagccctcaccaccccatcctctctggtagctcatgcattcccctcctcctggagatgctcttccttggcctcaccaccacctttctgctggttttcttcctgcatgctggcctgtatacagccctcacagcagccaggctggtatctgaaagatgtgagccagttaaggctgctcgttttaactctccaacgatgtcccatttagaataagattcccaacccttgccctgcccctgaaatgggtcttgcccacctctcaggccacatcccaaactcctgacaccttcacaagtctttgtcattgtttcccccctaccccaagatttgttcccatcagggggcctcagcactttgcagatccctctgtttggcatgctgttcccccctccatctccctacaactggttttcctagctggatgagagctctatgaggacaggcagtttgtctcttttgcctcctgctttgtcctcagcatctggaactgttcctggtacacagtaagtattccttgggcatttattaaaggaatgaataggcatgagattaaatttgcagtatctgaggttacccccaagtggaaacatctatgagtctacaatttcaggaaatatccatctgggaccaataatgttttaaaaatatattcatttgagattcagaaaacttgcacatcatttgctactcctatcatcttaacagtgaagaaaactgaggcctagagacattaagggggttgcaggtccagagacatgtctcaagaaagcattgctgttaaaatgtgcagttcgtgggttttcagtccatctcttaagaaaccaagtcaatcttcccctcaggaaaaagaaaagaagtagcaataagcaatttgttaatatcactacttcttatcaaggtaaaaaatgcctcataatcaggcatacccatgggccttgtttcacaaaggcactaagatgaggcaatgtaggtcccaaaaaacaaaaagacagttttttggagttgctgaggttgacaaccctagttttatactttggtaataccagtgaccttggaattacaagcttggggttaagaactcaagggttcattaagactccctggaacattctggaaaaccagctttagagtcttcattgaactcaaatctcagcaccacagttaaatgagtgagtcaaaagaacataagtttaaagaatttaaccaggagcagatgtttctcttcacaccacactgctttaacatccagtattcgtgaccttttcttccccccaccatcctctgatttacataggcttccaaagcattaatgaaacacactttaacaaaatgttgagatggtgccattgggcattgctatcctagttttaacccttggttaaaaaatactttgtgattcccacgactccagaccaacaaaaatataacagggtcctaatgacatttgaaactcccacggtaaacaaggcagttaaactaagtacttggggatggttttcattacagtgtgctaaaaaaatgaatgttttattgttcttttgtaaataccctggagaacactgggatggtttttctggaagatggaaatgatttaagagagtttcagagcacatgaagatatgtgatccctttgagtaacaaataggagatgggttttttttcgggggggagggaaggaacagctttgcattaacaactactgagaattatacatttaaagattatcttcaatgtccaataacccttatattcaatactgaatttatttccacttctcgccttcatttttatttgttacgtattctcaaagttctctcctagtagaagaatgaaccagaaatgaacataagcatgttggaattcatgtatgtggcagactgtattttccaaagatggccacaacaatatttctcattccacatggtctgctggaaccttgtcactcctccatcaagagctggaacccatgtcccctgtacttcaaccactatgggtccttatgacggcctcaaccaatgagtaggtgaaaaggacccttatgtgacctccaaggtataatcatcagaattccatgaacttctaccttcttctcttgggatgcttgctcttagaacctagctgccatgttttgaggaagccttaagcagtctgtcgagaggcctacagccaacaccaacttgccagccatatgagtgtgccatcttgaaagtagatcccccagctaccaccaaacagcccagttgataccatgtgaaatggagattagctgcctctgccaagtactgcccaagttgcagatttgtgagcaaaataaatgactgctattgtttaaagccaatatgttttggggtggtttgttacacagcaatagacatcttttaaaatacagtgatcgtcactaatccatacccacaggaaataccagactgcaatgattttgtaaagtgtaaaatctaaatcctttataaaagatgcagttagcagcacactcaaatatacagaaatgtaaacgaggataacacaaaagctctgaaggagtgagccttcagagatctgctttaataaagaggtaagagcaatttgtaactagcctctcagtttgtgatggtgcatccaaactgctggaaaaagcaggtagccttgaggtaaataaacactgcccctgcagcttagcttacattattaattggtttagcaaacctgtatgcaaacttaggcttagttcttgtttatcacaagttacaaatgtacagagcatgaattaatgatgatgctttactattcaaaagcaataaagaatgatgcccacattcccaggcaccatcagagtcagaaagggtcacagagactcctgtgcttgaaacttaaaaaatatatccatctgtgttattcttaaggcatcataacgagaagctgtcattgccctctggggagtgtcttagaagttagtcagagtagacactgcatctcattcaaactgggaagtcattggaaacaaaatttctacaccaactgaacgatgaatagttcatcaaaaaactaactttatttccaccaggaatatatttaaacattttcttttaaagtttttccatctcttcaggtgttttccatctgatttctactccctgtaccccccatgacaacctttttctctctgaagaatctttctttctaacagctcctttgactgcttttgcttttgcccaataacatccctaccaccccatcaataccaccactatcacctttaccaagaccatcactagtaccccaatgaataacacctccatcaccctcatccctaacatctacactacgaatctccccccagctaccttttcaaaactaggaatgctgctatcaggctaacagaatgaagatgtagattgggaagtaattaattagatgggaaacctcagtttaattctattttctcattatttcatatgctaaatttataataatgaattattaaaatacttgactcttttgtccaacttacatatcctgggttacatgtatagaatacagtaccacccctataatggtaatatgccctttttctcattcttttaaacacataagaagtcaaaagtgatcccacaaatgaatcatttaaagtttagatttttctcacaacagattttttccactggagtgtcagaaggcaatgtttatttttaaccttaaaaggaaaacaaactttgtaaaaataatagcccttatattgagctccaattacagttgttagttaagtgggaggacaaaaatagttaccaatcaatcagcaaacactgccatagtggatgaagagcagagggaatactaagacatacccagaaaaattcacaaaatgagggtatatggcaccgaaacgcagcacaccactatcataaacctgaactaatcaaataaggctctttgataatgaaggggaagtcatttaaaagctggattgaccatagactcacagaatatcagagctataggcaatcctagagattatcattctagtgcaaaggttttttttttgttttttttttttgtttttttttttgttttttttacggggaagaaagctaagaatttcagaaagtgaaacatcccacctaaatggctgcctaagttattaggtagtaggtttctttaactggaatcaggagagaattctggaactgggtttaaagttccagatttcttgaggaggcaagtcagtttcaataattgagtatctcatctccaagtgctttctccctccctgcagtgtcctctagccatcttcagccctgctgactccaatcctaatgggacctggctctttgagtgggaattctcccaaaggcagaaaaggggaaaaccttatgtgggttgtaattctgtcacactgattctcaaaaccctcagaaaagattttacataatcacaagcaattaaaatgaaaccttccagtgtcaggggaagatacagcaggcagcctaactgcctgccaggatacactccatttctcagacaagacaccccaccctcacatgccatgaggttagttcaaattcccacactcattatctgtgctggatcccagacaggaggtgtcaccgaggtgggatgttcagcacttctgaacacacagatgggaaagttcaacctgtgctgtaaaccagtcagctgccccatgtgttcactgacggtgcataattgacactcaaaacatgttccagctcataaaaagtttacatatataaatatatattacatctatataaaagtatatattacatatataagtatatattacttatacatacataaaagttatatgtgtatatatgtacacacacacacacatatatatatatatcataaataaaagtctggaaattttcctggtgataacagcaaattccatatttgtaaatgagtctgctgggacgtatgaagcattaacaggtgatatccaaccctcacaagtcacttccagggagggtttttcaacaagtcccaaccatgccagatactgaaaaaagctacttggagttgcaaaaaaagaaaatgtgtgagtctcctaaccctctgtactttatcttcattgcatcactgttcacagcatctgttcccatacaattctgaggccctgcaagccttggaaacacacaggctcttgctctttcattctataaacattcactgagcacatgctaaatgacctattctgagctcagcatcaaacaaacaaacaaacaaaaaatgacaagaaacaatacacacaataagtaaaaacagtaacgtgtcttaagaggtggcaagaactttaggtaaaaggaaaatagaggagacaaagggagtccaaaatactagggtagggagtggcaggaggcaagctgctctcttaaagatgggtgggaaggtaggtgcactgaggtaacctggaacgaagatttgaaggaggtgaaggaatcagccaagcagatatctagggatagatgcaccatagacattatgttcactgccaagagtgggaccaatattcactaactacagcataaaactccaatgcacataagacagaaagtgaaatacaccacttataaacactcatacactatacagcctggatataacctagtgatctcctggattttaccccctaaaatgttatttctcaaaaatgagggaattgctctgacatttacatacgttcaagatctctcacaatataaggactctctcagttactttattttgaacagcaagatgcttcttggggaaaacatattcaaagctactttgggacatttattgaaataagctgatggactttttttttttaattttttttttttcagatggagtcttgctttctcacccaggctgtagtgcagtggcacggtcttggcttactgccagctccacctcctgggttcactccattctcctgcctcagcctcccaagtaggtgggactacaggtgcccgccaccatacccggctaatttttttgtatttttagtatagacggggtttcaccgtgttagccaggatcatctcgatctcctgacctcatgatctgcctgcctcggcctcccaaaatgctgggattacaggtgtgagccaccgcacccggccagacttttttttaaggaggaaaataaatctaagaaaaatttaaaataattcctacaacatggaaaacaatttggggtgctatagtaggcaatcttcttaaagatggcttttaaaaaagcaatgcagggctgggcatcatggcttatacctgtaatcccagtactttgggaggccaggatgggaggatcacttgaggccagaaaaggcatttgagaccagcctgggtaacatagcatgaccccatctctataaaaaaaatcttaaaaaaattagctgggtgtggtggtgcacacccgtaatcctagctgcttgggaggctgagcagggaggatggcttgagctcagggtttgaagctgtagtgagctatgactgcaccactgcactctagcttgggcaacacagtgagaccctgtcccttaaaaacaaacaaacaaaaaacaaagcaatgcaggaattctacacacaaatgaacaccaatgaaccactgtgacataaatgaatctcacagacacagtgctgagcaaaagacaccatttatacaaacaggcgaagccaccctttggtgttagaagttagagaggcttcccttggaaggggagtggggaattgtgggcgtggctacaggaagggttcaggctgttgctcctgctctattaatatttcttgagtgttggttactcaggtgtgttcattttgtgctaactcattgagctgtacacttatgatttatgcactcgcctgtattgatgttattttcaataaaaagaggtgttttctatttttttttaagagcaatgtgaagtgtttccattatggagatttcttattgacatatgagctggacaagaaaaatcaactctcctaatgttatgtgactgagcacttatgactcaggacagaatttccagagatagcatcatttatgaattttaaaagtgctgaatcccaaacaatttggaagaaagtaaataggatgagcttgaaactgtgttagatagccctgaaaatcatgctggtgatgataaaggcaaccaagtgcaataatacatgaaaaaaaagtacagaaataaaattgttccatgagatttaaacacaggggaaaagcaccatttccaagtttatacaatttatataatttaaaatatgcatgtgcaattaaattattataagcagaaattatttcaaatatattcctcaaatgttatatgccaaagttggccccaaactttttaaatgtttttcatgggaaaaataggagcttgtcttttagatcttggcatatatgccttatattgctctgtgctctgcctccccttatgactgagaagactcaatcacaaatgctttgtatcaacttagaaattatgaaaaactgaaaattgtttaaataaatgaattctactaaaatatgctgtccaagatagtagccatatgccacatgtggttatcaagcacttaaaatacgactcatgagaccaaggagctgaatttttttttttttaaagagacagggtatcactctgttgcccaggctggagtgcagtggtgtgatcatagctcactgtaacttcgaactcctggaatcaagagatccacccccctcggcctcctgagtggctgggattacagacatgcaccaccatgctcagctaattttattttttatttttgtagagacagggtcttgctatgttgcccagaatggtctcaaactcctggccttaagcaatcctcctgcctctaattttaattttaaaatgaaagcaatatgaaatatttttctgttaagtacaactttactttgtagaatatttcgcttcaattattgaaaagttagcatccaaattgagatgtgatttaagtgacaccagattttcaagactttggcctcccaaaatgctgggattataagtgtgaaaacctgatgtcacttgaagccttgaaagaaacctgtaaaaacttgtaaaaaattttttaaaaagtaaaatatctcattatatgttgaaaagatactattttggatatattgggttaaataagacttattactaaagttaatttcactcttgtttttacttaacatgactattagatttaaaatatacatagatggttcactttataagacagagttgctaaggaataaaatgccatttttgatcagagacctcaggggagagataaaagaaagaaaaatcaaacctggaaagactgatatttgaagatctgattaacagctatggcagaaaaagtccaggagtcaggagaaatatgagaaagcagaaaggaaagggagaaaccagtgcatctttttttaaatttttagaattaaaaaaaattttttttagaaacaggatttttctctgtcacccaggctggagtgcagcagcgtgatcctagctcagctagtgcacctcttgagagaaagtggtcagattacccggggctgatccagacagcacagcaaattctatctacaattccacactgtcaacaaatccaattgacctagtttttgctaggtgttagaagattgctatatctgttattaaagacactagaagaatggcagaagtgccgagcacgtctttctagagtgaaaaaagagaggagggagtttttaattgctctgctccaaatctttccctccattagaggtttcattgaggattagaaaacacacagttacaccaaatgtttgggacaggaagatttgttttaatggaaccaagaaaatgcaataaagtactagattcatttgaatctatggcaattttgtacttttgtaaacagccaggattagtactcattttaaaaagaggactgagcgcagtggctcacacctgtaatcccagcacttcgggaagctgaggtgggcggatcacctgaggtcaggagtttgagaccagcctggccaacatggcgaaatcccgtttccactaaaaatacaaaaattagctgggcgtggtggcaggtacctgtaatcccagctactcgggaggctgaggcaggagaatcgcttgaacctgggaggcagaggttgcagtgaactgagatttcaccattgcactccagcctgggcaacaagagtgaaattctgtctcaaaatgaaaaaaaaaaaaaaaaagagagagagaagaaaacctgtcaacagatgaatggatgaaaaattgtaagaggtatatgtgtgtgtgtctaatggaatattattcagccttaaaaaatatcttgccatttacaacatggataaacctagaggacattatgctaagtgaaataaggcagacacgaaatgaaaaatagtgcatgatctcacttatatgtggaatcaaaaaaaagaaaatatcaaatacatagaaacaataaaacactggttactatggcagaaaggaaatggggagatgtaggtcaaagggtacgaaattgaagatatgcaggatgaataagtctggagatctaatgcacagcatgaggactacagttaataatattttattgtatactggaaatttgctgagagattttaggcgctcttaccgcaaaaatggtaactatgcaagatatattaatttgcttaactacagtaaccatttcactatgtgtatcaaacagcatgctgtaaaccttaaatatgtacaataaaaataaaacttaaaaataaatagaaaagagagaagaaactgaccacacccccgcccaccccactgactacctgtgatttttccatggttggtaggtggtcaatagattcatcattgatttggtacattttccgaagtatgtgctatggtatagataggtatttggtctcggtctctctccctctctctctctctttcttttttctttctttctctcaccttgaaaaatagagcggtatttggagaggaggaaaagccaggagaaagttctcaggtcattttgaagaatgccaagttaaaccaagcaagcaagttttgcacccgggacctcttcagagccttgactcttttaagaagcatcatgggccgggcgcggtggctcacgcctataatcccagcactttgggaggctgaggcaggtggatctcgaggtcaggagttcgagaccagcctgcccaaaatggtgaaaccccgtctctactaaaaatacgaaaaaatcagctgggcgtggtggcgggcgcctgtaatcccagctactcgggaggctgaggcaggagaatggcttgaacccgggaggtggaggttgcagtaagccgagatcgcaccactgcactccagcctgggtgacagagaaagactgtctcaaaaaaaaaaaaaaaaaaaaaaaaaaaaagaagcatcatgactctccaagagggcttacttacaacgtgtgtgcctctgaaacatactggagaaggaaaactcttacccagcagcattccagggagggtgcaatcaagagccattggcttggatggaaaacagaaactccaaatcttcagccctttaggcttcactcttggccaaaaacaaacatgagtgtctgctgtgagcaagaatggttcagagacaacaggggccagaagctgtgggctgccccagctcatccactgccagtctaccttgggacccatctcaatagggtagggacaaagtaacatccaggtgccccatggccacagccaggtccgggagaagcagctgctcacccctcaccttcaggagctcccaggttggcctacaatcaacccaaaacaccaggcctcaggcaaagtcatgtcagccttgataccatcaacctcctagcaacaagcggaatggagacatcccctgggtggctggaaagtcaccttgagatgacagagtgttatgcccaggcccagtctctccctggaacaaagcattcctggtcacacagctgccacctccccttggttaccttctgcttctcctctggtcatctgcctcctgcactagctctagaatagttttacttccttggatgtggggtaatttctctgcagtgacgacaaaggagtacaggcctcacagcagccacaggctgtccacagagctaacaataggccacttgtctattctgtgcacattttttagggatcccaagttgttatttctttctgatttaactataagtcattttattattatttcatatgatatgtgctccaaatgctaaaaattacataaaattttaatgctttacatgggcaagatctaattccctggtcagatattaaaaccaattgctcaataaaaaattatattaaggagaacaatgaagataattcagcaaacccatgagaaaaaaaagaacatcttaaaattttaaattttaaaaaaacaacctcagaactatcctaggactaaggcaaaaacacacaagacctctataggataaatggcagcggtttttaattgtaccccaaaaacattttggatcatgcctcacaaaaatatgcttctgtggaggttgccagtgacttcatggccactccagcaatagctgtttctgacattagtcttaggggttagtggaaagggctgataactcctccatcgctgaaatgccctcttcccctggcctccatcccccacactcagcaagtttcacactgacctctctggctacttactttttcttttctctgaatgctggaattcccctgggctcagccctaaggcctttttccttcacaccctcccctccttcctgggcgatttcatccatgaccgtggtttcagttaccatctgccagcaggcgtctccagcccagatctctgcacagagctcctgaagcacagatgccacagctcattctgcagtcatccttatctcagcaaagggcccattaatccaactgcaggagccaaaccagccttgtcctctccctctccacggtgcctcgttaccccatccagaagcaaccctggtggtctgcctggctcaatatttcttagatctacctctctacatctctgtcaagacgctccacctaaactaagtgacgatctcttgtctatgaagagttactccaacagggtcctaaccacacccactcttgacccagaagccagtcactaacctgcagccattctgatctttccaaagtatacatttaggaatcattctccagctgctcctgaaagccctccagcagctttgcactacacttaggataaagggccccatcctcagcctggcctgcagggctgtatggggacccgactcactctccagcctcactccacctcactcacccctctgtcatttgcaggcaagacagtgaactcccttctgctcctcaaaccaaacttactccctcccaccttggctttgtctgagctgctccaggagtccccaccacctccaccctccctcccctgttgaccctcaggtcttggtatgtacacttcatggagcactcccccaacactgccagcctggggcaggccccttgccatgttctactcgacagcgctcacccatctgtgatcctacaaccctcatgtgcccatctgctctgtgtctgtgccctcagctagactctaagtttcacgtgtccagggcattacctagaccggcttactaaagtattcccaaacactaccagcaaagatctgttcaaagaaatgtgaacgaaacctgacccactgatgctggacagtagattcccgcagagggagaaaatgaagcacaagaaagtatctccttttttggggagtgattgagacaagcgtatgaccccttccctccctccggcttaaattaacttcagcgaacctctctggacagaacaggaagatcacaggctaataaaaatagcaagaggacagaggatcaagagaggccagggtgggagaggaacttcataagaaaacagcggcctccaggcagtagctcctgcattttttcctccattaggaacatctaagcctgtaaccttcctcctccctcccctgccagcatcaaaggaggggatgcccattaccttgtgcccctcccacctcgccctgcctggaacctgcctccatcttttatcacctcttctctcccaatacctttcagctgaaaaaaatgttcaaatcttccaggcatggtggctcatgcctggaatcccagcactttgaaaagccaatgggggccgatcgcttgagcccaggaattcaagaccaacctggtaaaaccttgttggtttgacaccacatggtgaagccctgtctgtaacaaaattagctggccatggtggctcgcgcctgtaatcccagctacttgggaggctgaggcaggaggaccatctgagcctgggtaggtcgaggcttcagtgagctgttattgtgccactgtactccagcctgggcaacggaatgaagccgtgttaaaaaaaaaaaaaaaaaagacggggtggggatctcaaatctcctaaagtaaactgctcttctgtccttctagacacatttacttaagcccatggcaggaaggcctctgcctgttttatactatgacaactgctcttgcaaaacttacccgtggcatccagtggccaaacccggtgggcccctcccacttgacctcctcccagcttttgatactattctccatctcttctcaaagcatgctcttcccctggattctgtaacatcacactcttctgttcctccctctaccttggaaaagtgctatttttctttctctggattttaccaaagtatatctctgttatgaattggcaaaaaactggtccttcaccacagatagcgtgagacaaactggtctagatcttgcagtctttttaatagatctgtctgcttacgctgaaaaaccaagaaacctcacaagaaaatataaacttaacttctctaaaacaaagccagccaggtgcccaaccaaacaacagatcttgcaattttgggtccatatttccaccaggcatcagagagcggaggctcagtggaaactgccccttgagatgggcatgtgccactggatgaccatccttaccaccattcttgcctgctctcagggttgacacctcagacacccacatctctgttcctggctttcttgcaagtcccagcccaacaaccacagctgccttctggaatgttccctgagtgtccccctgacccctcaagtcttcatacaaccatccccattctcatcacctctctgcccccagggctcctcatgctgtgttcttggtccttacagatgaccccatctcacacctgagtcacccaggtgtcatccttggcacctctctctccttcaatgacacgaaggtttagtgagtattcctctttctctttcaatgtatccattaactcgacgcttatgtattaagtcctgaagacacaacagtaagcagggtaccccattgccccctgcaaggcctgcgccagccgccagctcactgtcttccactctgaagacacactcattgctgggatgacactccattttctgcctttacttcccctcaacaacccccctccccaggttcatcttttttaaatgtcactattctcttggtttgtgggtgggttctggtgcagcaagcacaggagagcctttttaacataattttcatttcactctgaattggcatcttaccctaattaaaattagactctctgcaccgcacttgtagaaatgaaactctgaatactcaacaatcagccagaaagtaaatgatgagtcatttacataacaggcaaaatttcatcatcccggagatttgggatattctgtttcattaaaagaagccattgagatttttccatctgtcaaggtgctttctttaggttgaggcataagtagcatcattcggttttctgaaggacaatgtactcggtttaatccaggacagtacactcattgagtgggaccagccgcccctcaacggtcttcattgcaaaggctcagtgggccagtgcaagatgaacctagttcttaaggagatcagggaggtcaggagctccatcacaaaagggagtcaacttggggaacagagcccagagctgagggcctgaaggcaaaggccaccatgtcttatctggacaagggcagggagcgtggctttctcccgcaggcaggacgaggcaatttccatcagcagaacctgggcggcaagggcctggagcccatccttcactgaggggacaccttcaaggcactccaacatctgaccccatgtacccaacacgcgttatggccatttgcctcctatgctcaacctcacattctggctctgacagcctccacctctgtccagaaagggacaagctatacaggagaggtagcatggccaagtgctctagaacacagtccctgggtccaacaggctgggttcatatctcagtcctgccatgcacagttataacattggcaaactgcatagcttctctgtgtctcagtttcttcatctgtcaaatgaggataagtcttcacaggcatgagatgagggttaagggtagagtagacatgagcacttcagcataaggtttgcctaacgcatgaggaggattccctctgcagagtaaaatcttattttaaatttaaataaaccatagatacacaaacatgggccagcagcatatgagagacagagacagagacacacacacacacacatatattatattttatatatataatatataatatatatataatatatattttatgtatataatatataatatatatataatatatattttatgtatataatatataatatatatataatatatattttatgtatataatatataatatatatattatatatattatattatatattatatataaaatatataatatataatatatattatatattttatatataatatatattatatattttatattatatttatatataaatataatataatatatattttatatatattatattatatttatatatatatataatatatattttatatatattatattttatatataatatattatatttatatataatatataatatatattttatatatatattatattttatatataatatataatatatattttatatatatattatattttatatataatatataatatatattttatatatatattatattttatatatattatatatatattttatatattatatattatatataatatataatatacattttatatataatatataatatacattttatatatattatatataatatacattttatatataatatataatatacattttatatatattatataatatatattttatatataatatatattttatatataatatataatatataatatatataatatgtaatatataatatatataatatgtaatatatattatatataatatataatatataatatatataatatataatatatatacacaatatataatatatataatatataatatatatacaatatataatatatatacacaatatacatatattttgtttttctcctggtttcctgtatttcttccttgggactccatgccatgccctacatctttacagtaaacccgcctgactcactagagctcgccagactaaggctctgctccacataatcaaaggaagcccacccagaacagccttccttctcttttgtccaagctacactcaagtcaaacaggacttggctcttcctcagccttatgccttcaacccatgctcctgtgcatgccagcaacggcacagagctgcccaccttgcctctcagcctcctccagtctcagttcctcactttgcagagccctcgttccacacctctccgaagctctctccagtccacctagccaaagaaccttctggccactctgaagccccttggctgcccactcgtgcctctcctatggagggtctaatccaggctccatcatttagcagttccagcccctggacaaagccctctgccccttgagcttagtttcctggtgtctagaagggagactccactgccattctggtctctcaaatggaacttttgagagaccagaagtacatgccagaaaacgtgcacaatgactgaaaacttcaaagtgctctccaaactgtagacctttcccatagacgctctcatgaatgaacagcaatttgaagatgaacacataggctgttcattctgtgtcactctgcctgctttacaatcctctgggagccctgaggagtgggaaattccagaggcccccacggacctgccagccacacagtctccaggtgcacctgatgggctggttgagccctcgtcccaaaggaattctggcagcaccatcactctctcacagcttctcaatttttcatccctcgagcattcggctctaggacttagaaaacaagtctctccaagtctgcccatagctctgcattttaaatgttctgtggtccataataacttacataaagggccaataggatggaacacagcaggacacaacaggagaaaacaaaatgcagtaaggtagatttcatttgaccagctagagcactcagagaaactggccacaccaaaaggaatggagtcatcatcatctttacacaactcccttcacactctgaaaagtcatgatggagagaggcataaattacggcgtcttcagctaattttacatgacacagacacaaatgactttacttttcctaattgtgagaaataatgaaatcttctctccctccttctatccgtgtcctctatccaaaggttctgctaatttaaaacatttggtggaaaaataatactggggcattgttcttatgaaaaaatctaatccttttgagtttaattctaatatgcagagaagaatatgaacctgtcctgcatgatggtactatgacaaaacgagttaattaccatctcatcctaagatcaatctacttgtcataggaacgggagccattatttcacacaaaataatgacccagataaaaatgactgcaagttgaggcggccaatgacacagcttcatcttgacctaactgagctgcaattaacaagtgtcaccactacatatatataaatagggccaaagctattcattaaatatttgcagtgaaaaaaaccacaaatggtttttagcatacttcttcctgggaagcacctgtggtcttctacctggtgtgatgacagaaaaatttacacatgtaaaattcagccatcagttggaatagccacgggtgttggagaggtacgtggaattgtcctctgctctttgcacacagaggtggtattttctttagaaattatggccagcaacagaaaagaggagcagggagaagggggcccagtcccattattttgtcccacttcttgttgtcatggcaactggactagaaactaaagccacagccagcaatgacagcgagaaatgctaggtctttccaagtccagccctgtccactaacagacaatgcgggggcaaacggtggggcaacctcaacacacctggctcctccaaggcaggaatgaccgtaagccacatttctgtttagaggaacagagatggaactctgggatagacatctggagacactgcgggtcagaaatctcactgctgccctggtttacaagctgtccagtctgtcttcttatttaaaaaccaagtgtatgacaggaacaggatgatacgatgggctttaaagcctattattttcaaaacgttaagaacagaattcttactataagtcttcacttaatgttgtcaataggttcttggaaactgagactttgagcaaaatgacaaatgaaaccaattttcttctcaaggttaaaactaaatgacactgaatgaaattgaggacctgctgtatgctgtttcactaaaagtcagtttctaagaacctacacagtgttaaggacttatacaaacacagaatgagcaggtgtcatttacttcataaattatctaatgaatcatcagacacacatgtgcatacacacatctataatcagtgggaaaaaaagaatgctggcataaaagttaagataaaaactggctaatgtccttcagggcataaaaaccctaactttgagggcctttcccactggacagatggacatctccacttgggtactacagaaacaacaccccagtagctcgcaaatcgggctgtttcctgaagaactgagacaggaccactgcaatgggtcagccatgcaataacctaatttggttaagacaaagtcaccaactcatatcaactcatatgttttctttcttttaagagactgggtctcactctgtcagccaggctggagtgcagtggtgcaatcatagctcactgtggtctcaaactcctgggctcaagcaattctctcgcctcagcctctagagtagctaggactatagtcaagcaccaccatgctcggctttttaaagagacttttttttttttggcagagatggaggtctcactatgttgcccagtctaatctcaaactcctgagctcaagcaatccttttgcctcagcctcccaaagtgttgggattaccagctgagccactgtgcccagcctcaaatcacatgtttttaaaaagcatatttgagagtgggcagagccttatgcctttcttttactcacttacccctcaaatattccaagcatctgagtcttaattacaaaaccatttctaaaatgattttttcctggtattcggatcatagggtaaattccacttctaggatgtccctatacaagttgattatttgcagcaatccaaacaaagatagctctatttctatagaaagctacatgcgttattaaaacacttgtgttctcaggcttatgcgtatgtgaacaaaagctacttcccccctcccccatttcttaaataataatctgaattctaccagagtagaaagagcctccctcatcctagtaaaattaccagaaattctgacctcagagatcatctggctcctggtctatgggccatagacccatacatgagcggctactcccagagtccctggagcctgaacactcaatacatgttgaagggagggtggcagcaaggaaacaaatctcctttaaagggacagcctaatcattttactgttatacaaaattcctctcaacggcttcccgctgcctttacagccctgtcccagctgtctctggccccttctcccgaccctcactctccctctgacgttcttttgattcccctcactccctcctgcctcaggccctcatgtacactgttccctgtttggagggcttcccgacctgtccgagcacagccgcatccccaaagacaccccgtcatccttcccatctcagctccaagtaccttccggatccccttgctcctcagccccggccacttctgctggtaacactcactagttcggctgttttattctctgtatcccagcatctagtacattcctggctcaaagctgacagctgacaatatttattaacaaattccctaattggctgattggacctcaaatcacaatcacctgtatggggtggggaattgtcgattactagggaacactgggtaagagagaacaagataagcatcaagcagtgaactcagccccagtttggggctaggacattccttctgtagtaaatatcatattaaaactcaagtagaccctacagttaggcacaaaacctcatatggttcactagttcggctgttttattctctgtatcccaacatctagtactattcctggcccaaagctgacagctgacaataattattaacaaattccctaattggctgattggacctcaaatcacaatcacctgtatggggtgggggaattgtcgattactagggaacactgggtaagagagaacaagataagcatcaagcagtgaactcagccccaatttggggctaggacattccttctgtagtaaatgtcatattaaaactcaagtagaccctacagttaggcacaaaacctcatatggcatgaagaaatatgaattccctgcaactacgcagttttccctggtatgttcgaatgtgggtggcccaggactctggcatgcttccacactaggaagggaagggggcttgcggcaatgaagacccatagataaaaggaaggtgggatctgggaagtcacattaccatgagggtttgaaaggagtcccggcgcaggcctgcaggtctgtcagctgttaaccccactccagctggaaaagacaggacccgggctcctgcatgcctggggaggaggggttagccatcttgttccagagtcagctctggagggggctgcttccctgtggggctgccaaaggtttaggtcacagctcttgcatggcctcttgagtgtggctgatctgtcctaaggcagctacctgcctgttcactcaggggaacactcgcaaacctcttcaatggtaccctgactgtagcgctcaccttcttaatgaactctgggatgagtttctggtctgtcgggtggtctaaggaggaacagcaatctaattccaagatgtagccttcattgtgaagatcagttttctgagatctgaagagaaagaaaagcacacacagaaacagattaatatcttgcataatttggagacagtctcactcttgtcacccaggctggagtgcaatgacgcgatctcggctcactgcaacccccacctcccgggttcaagcaattgtcctgcctcagcctcccgaatagctgggattacaggcacccactaccacacccggctaattttttttttttttttttgagacggagtcttgctctgtcgcccaggctggagtgcagtggcgtgatctcggctcactgcaagctccaccttccaggttcacgccattctcctgcctcagcctccccagtagctgggactacaggcgcccgccactgcgcccagctaatttttttgtatttttagtagagatggggtttcaccatgttggacaggctggtctggaactcctgatctcaggtgatccgcccgccttggcctcccaaagtgctgggattacagacatgagccactgtgcccagacgcagaatatttttttttttttttaaaaagaatcattgggtctttaatgaagccccagattctttcccgaaagtaacgtcaaaaaggcactgatgaaaaatggtttatggaaactactcaagtaatatatacatatccacatcatagtaagacctctaagatgtagcatcatgtaaaacacatcattatagaatgatgggtttggtacaatacagcttacatgttatacacacacacacacacacacacacacacacacacacacacacacacaaactctcactccagtaatgtctatgtcccattggtttatatccgccagggcacagaaaaagaacaagcaagacatacaccaaaccaataatagcaggtacccctggggaatggggaaggcttatgtggatggggatggggatgggtggtgatggtatgggtgtgggggtggtgatcaaaagtgaatttagccataatccctaattgttttcatttttaaatgaaaagaatatattcctatatcacttagaaaattaaaaattaatttttaaaagactttaaaagggttcaacccctttagagggcaatctggcaaaatctatggaaattaaagatgcattaaagaaagactactgagcaactaaaagaaattctgggaaaacagcgtgggtgtaaacggctgtctgaggtgaaggcctgtagtcttgctgtcaaaggagaggcttcctagcgcaccctgccatctctgcacacaggggctgctttccaaagcaccaccacatagacatccctgtgatacagcacagttcaaaactgcacccattcaggagagccagcagcaagtggtcaccaggaggaaattccaccacttcacagccattcacaggcagggctcctgtatgacactagagtggaaatcacgtgggtgtcagaaattgaagaggattccttggcccagccaggcataaggcaacaagagtggtactgcagctaaaggctggcagaacgtgctgtctcttctaggtggctggtggtattggggagtgggaattagagaccaaggctcccagctccttgtccagggctcatgtacacagctaatctgcactggtggaggagggagcagagccctcctggcccacttatgaggctgttctaccaaagaggggcccctgaagtccctgtgagagcaggactgtccagaaaatgcataaagcaggcacttccacactgaactcctgagatacatgcatctcaccagtttctaactgtgtatttgctgcaacgttttaaataaatttctaagattcttatatagcattaaaagcaatttctgctaccattaaccatctgtgtatgattcaccttaaatttaaaagtgaaaaaaatgaaagaggatttggttttccccaggtgtgcaactgtgatttggtaagcaaacttcaatagcttatttttatttttctttccaacatacccttccaagggtagggtactgtggcgcatacattcaaaatgtaaaacaataaactgatttcaatctggaacaaactaatcccaaaagaataaaccaattctgaaccctaacctttttgccttaatacttggtcagagactagactcatgttctcatttcctccccaaacaaaagacatattaagaggaactaaggcagatgattccagacctttgaaaagaagacttggtcaagacacactgtcatacgtaccatgtgaggtctcaaacaacaaaaatcaggatgagggagagggggttctaaaatctaaaatccagctgttctgttacatggaaacaggctatatgaggttatttagaaatatccattgagatttcaaatgaatagactaaaaaactataatcattttaaataagtcaatgctgtatccattaagtacaacattcacaggatgaacaaaaggaagacaagttggtctgtaagcaactcacagcccagatcgattctagggaataatctttagcatagaatctaataagtaccatctctggttctggaacaagaagttctataacaagaaaggaagctctggttcatttcttcaaataattaactcagttacatctgaactgaaaggggcacaaaagatcaagaaaaataggcattacaaattttttagatgaaccatggaaaattacatctcagcctatggtttcttggaaaagcaaatctaatgcatattgggggaataggtgagcaagtaataggcgttctcctgcctttgggaattagctcctcaatttgaaatgaaaggattattacactgaagaatggctgaaagggagaggaagggggaaaaatccctaaaccccttgaggacagatgctggctgcccagccttgaagtcagcactctgtgatggtgcagctatggcctcacagaggaagagctgaaggcagaaggcacagtcacacagaaactctctccttgccactaatcctatgaaaaacagcattaaatccactagcaaagccctatagagctgccagagggagtttctgggcttctcagcactggaggtggggagtgaggtggtggtggggagaccatggttgctgtggcaaacacactctaagatgacccccacaacaatccccacctcctggtgttcacacttttgtgcaatccagccctttcagtgggggcagggcctgtgacttgcacctactcaataaaacatggtaaaggtgatggatgtcactcctgtgatggcattatgttatatgactccctctgagctagagaatcccttactggctttgaagaagaaagcttcaggaagaaggagagagccacatggcaagaaattgtgggtagtccctggccaacagctgcaagaaaacagagatcccagtcctacaactacaaggagatgattcctgccaacaaactgagggaggctggaagtggggctttcctcagttgagcctctgatgagactgcagcctgagccaacactgatattacagcctgataaaattctgaagcaaagaaccctgataaactacagaaaccatatgataataaatacgtaccattttgaaccatgaaatgtgttatcatttattacagagcatagaaaactaataccaaaaaaagaaaacagaaaactaacacagttcctgaggaggaagacatggcagtttcatgcttagaacaggccacccactggtgaccaggcctaggcccaaacccacaaaatccagccagacatctgaaagcagctccatcaggtgaggagtgttctgtgtccctgagggcaaggactatcctgggagacagaagtggacatgtcctagaagtgacctccagggctgtggcctggttgtccaagataccacaggacaaaggaataaatattccgctatcaatctagtttctatggaagaagcattaacctgaaactcccagctgagcaggcattgccaccttcctatggggtagtggaaataccaggtatgctccccaaagggccatgtcattgtatcatcctggaaaagaatatgggaaaccaccaaacttcccctggacagaagtccagatgacttccacttttggaaaggacagagagatctggttttaaacagtaagaaaaagaaaacacagaatgcatttctggagacgtacacagggttaactaacagcaaaagcccccccaacctactttatctggaaattaacactaagcactctccaattaaataaagacactctgaggagagcatgactaataataaaatatgcttccccatcactcgccatccccaacttggtatgataattccaatagatttattagttagaggctaccggtgttagagctaactagaggcaggtaatacaccagctgtgagcctttgggcaatttacttaaactttctgtgcttcagtttctttcactaatgaatgggatattatacggagctacctcttaacattgctgtaaggattaaataggacaaaaagaagcaaagcccttagcacagaggtacaacatccaggctcaacaaatcctacctgctactgatctgttattatcatctataattgtgttcttacttttccttcctagcacttttcacagttcattactcattcattcattaaatatggaccacactactactgtgtcaggtactatactttagcattcatcaatagatagaagtgacaaaacctctgcctttgtggagctaacaatctaataggaggagaaagacaataagcaatagacatgcatgagcacctaacagagtatgcccaatggtgggaagtcttgaaaaaaaaaaaaaaagaaagaaagaaaagggctgggcacagtggctcacgccagtaatcctagcacttcgggaggctgaggtgggaggatcacctgaggtcaggggttcgagaccagcctggccaacatggcaaacccccatctctactaaaaatacaaaaattagccaggcatggtggtgcacgcctataattccagctacttgggaggctgagacagaattgtttaaacctgggaggcggaggttgcagtgagccaagatcacaccactgcactccagcctgagcaacagagtgagacttcatctcaaaaaaaaaaaaaagaaaagaaaaggaaaaaagaaacacagcagcagggtaaggtgaatggcaggggcagcagggagacagttgtagttttaatgagggtggtcaggatagctgcactgatgaggtgaaatttggaataaagacttccaggaggtaagggaccgggctcatccagggcatgagctctccaggcagagggaacaacagctcatgcaaaggccctaagctgagggcatgcaaagaagccctgtggccggggctcagtgcagaggggtgcagggaggaagacacagttggagagcctcaggggagatggatagtatagacattcaggccacagtgaagacaatggcttttactcagaatgacagaggaagtccgtggagggtgtggaacagagaagtgacatgatctggtgaattttaaaaggatccctctggctgtaaggggcagccagaagcccatctaagtggtccaggcaagggatgatgatggctcagagtgggttggcaacagtgtcctagcagcagtgagaagtgctgggttccagttatattttcaaggtaaaaccttcaagattttcatatgaacaggttgtggggtgtggaaggaggaaagcagatgaagatgactccaaggatctttgccttagcaactgggagaatggatgactttgccagaactatcatggggaagggttgggtggcacaggcttaggggggaagaaagataattcaagtttcagatatgttgaatatgacatatccagaagacatccaagttgagatgtctggtagacagttgagtatatatatatatatatatatacacacacacacacacatatatacttgaatatatatactgaagtctggactgcaggagaacggtctggactgcagctggagatataaatttaggagtcatcagtctcccaggtattacttaaagcatgaggctaaatgagctctccattaatgtagcaagagaagggttaagaatttaattttgggaccctccaccatgaagagggtggggtgaaaagaggaacaaacagccaaggagctaaagaaagaataaccagggaagaaggaagaaaacaaagagaacacgtttgttttcctggaagcaaggaagcaaggaagcaagtcaaggagaagggtatgagacatcctgtcaatttcctcaattaacaaatttataatcttctctccaagttacttatcctcttgaaatcccaagagggaaactgaatttaatccaccctatgcaaataggtgtgaagaaatctgttaatctgtttatctgtttatatgattatctggcagataatcatataaattgggcagattgtcaaatttaaattttgatttgggttcagaatagcttggctccttgaaaaaaaaaaatcatcatcttgctgctgagtcatttctcagaaacagcctggggaaaaattaactaaaaagagctctgacccatcttacatcttgggaccccccacttacacagagcactggagatttgagaggctgtatttcaccattccaaaggaattttctgaaaggagtgagaataaaagggtactactggcagagatgtgatttcctgaaaatcaagaatgaataggacaaaatgaactcgaatccttagagtgtagcaacatagttttaataatgcacataaacagagtggttctgattgctggaggcaatggagaagcaactaagacatctgagccccgttaagttttaaaaagccatcacaacatgacaactaaatgcagtatagtaccctggattggatcctggaactgaaaaaggacattaatagaaaaatggtaaaatctacggtttaattaacagtgaagtaccaatgtcaatttcttagtttgacaaacatagtatggtaatgtaagatattaatggtggtgggaaacttggggaagtgcatatgagaattctctggaatacctttgcaacttttctgttaaatctcaagttattcctaggcagggtatgttgtatctgccactctcctagagattttccttgggacataactgaacaagtccatggaaaagggaaaaatagaaagaatgacttataaagatgagtaatgtagactcttgtattctaagaggaaaataaaccttcaaggaaaaagaccagggataatgaaatgaaagaatggggtctatgcttcctctggtcagaaaaactcaaaactacttccaacttcttgctttccttacttttaaaaatttttttattatgataaaatacacatcacataacatttaccattttaatcatttttaagtgtacaattcagtggcgttaagtaccttcacaatgttgtgcaaccaccatcactacccatttccagaacttgtttttctttttctttttttttttttttttgagacagggtctcactctgttgcccaggctgaagtgcggtggcatgatcaagggctcactgcagcctcaacttcctgggctcaagcaatcctcccacctcagccccccaagtagctgggactacaggcacatgctaccatgtctggctaatttttttttttttgaattttagtaaagatgagttctccctacgttgcccaggccatcaagtgatcctcccgcctcagcctcctaaagtgctgagaatacaggcatcagccaccgcacccggcctccagaacttctctgtcattccaaacagtcctcatttctttaacaccttatatctagaacttgggccaaaactgaatgtgaacaagtaaaaaaaccacacacacattaaataatgcttgtcagacaaacatatgaaagtagatttggacactgagcacttgtacacaaatgtcaacacaactggccacagatgtcagggtcgtttcagaacatgataaaagacccctattctgtgtcaggttgacctcattactcatacacaaacatcaactgtaaaactgtgtgcaaactcagagatgtacctggagatcttcactcaccaccaccctagcgtctgccaagggtggtgtagtcattctccaggcaggggaagggtcagatggccaaactagcgctgtaaactcaaacgcccatgggcaacgagtgaaagattctttctgaaaccaaagcacataatctagacattttgttctcatataaaagcctgcagctttggccttccagctcaagcaatcctcccacctcaccctcctaagtagctgggactacaggcgtgtaccaccacacccagctaatatttatattttttatagagacagggttttgccatgttgcccaggctggtctcaaattcctgggctcaagtgaacctccagctcggcatcccaaagttctgggattacaggtgtgagcaaccatgcccggccttgtctgacccatttaaacagcccctcactctgctctcacagtggtgggacctaaccctttcctaagacattaaaatagcattgttgtaacaagtactgctaacacttatgagtgctttcaatattggtaattatcacaggcaaaacagttaaccctcaaatcactgacaaagtgccaagtagtaagttgaatatgcattttggtctcatgggaagatctaaaatgaggccactaaaaaacaattgcctgtcgaaaaactattataaactatacttctaaaaaataagcatgtgactaaaaactatgatacacattacttttaaataataaacatgtaataaatcccattttggctcataaatcccttagatctcttcaaagaccatgagtttaaacgatgtcttctttttcccaggacaacaggcagttatgaaaaggagagagaatgtgcagttcatcagtagggttatttttgcttcatttagaaataatcaaaaaaaaatggtgacaaacacaaacagattactaggcacttctccagccaggaaaaaaaatactaaacgtcagttgacaaaaacaaattctctatctctgggaaacaggaaggaattttaagatttttgtttcccaaagcaacaccaagctcaaatagaataatcagaacagcttatttttttttttttaaagaagtattagggagagaaatgagctagagatctgaaagagatttgtcaatgaaagaaaaagaaagctattcctagtttcattaacttacgtataactaatgacaataaaaatctccacttattcatttgtctatccatcacctgcttgactgctgaccacatatgagggattgaaggcactgccctcaagtctagatcctgccctcaagtctagatagactgtgtataaacagaagtgctatgagaattcaattatttccagtgtcaaggatcaggggaaaatttaaggagcaaggcgtgtgtgggctgagtctttgagtctgtatggaagttagtcatgggacaatggataaaaggacattctaggcctgagaacagaaattaatgaagacctagattgagaaaagcatgagttatatgatggaaataataaataggtcagttaggcaaaaggtgtgtgaaggtgcgggttgcctgtaactcagcagaggctgtaatgatgagcctagggaacgtgtgggtgaatccactgttagaacgagtctgtgactgtgggctctgcagtgaccggggcagaatagtgggaaacaaagttactgagaaaggacggtactcgccttaactgtgaagtaaagaagagtcatgggtggccttagagagaaagatactatgacagattctgggaagattaagcaggcggcagtgtgtatgatgtaggaaggggggaagaatattttaggacagcagcaatgagaactgtactgagatttttgtcgaagggagtgggtggacggaagagcagtatttcttgtccctgcaattggtggtggttgtgggcaggggaataacctgcaccttcccagagatgctcccagtacaatagggaaaaggtttcccataattttatgaaccctctttgcaaaatgaaccaaatctacacaaatacaatgagcctgttggagttaaaagtttcccctatagcaaaactgaagaaatacttgaggaaaaaatagtcaagtaaacaaatcctagcaaatctttaaataaagcacctcagtatagggtcccccaggggagttgtgaagtaggaagcacaacgaaggagaagaatttacccacagatgagtcactgtcctttcttccgatgttcccttccccttctagcagaagacattcagcacttctgttgaaaaaagtttggtatctctgggaacattctggacatgatgggggagatgtgcaaaggatactcccactacacactctctcagggagctgtgcatgcctactggggagatgttaccagggacatctaactatccgaccctgctatttattctagagaaatcatcctgtcttgctgcttactgtcagggctggctccctgggagacaaactatcagccactgtgcactacaaggagtgcactgttaaccgtaaagaccaagaggaaaacagacaaactttgcctcggtgctccctgtctaatggagttgtgaaagaatttcaatgcccagtgagctgggctgcagaaaagaggagagcagccacacagaatgggagctgggggagggtcctgctttctctggaatgctgcaagtctctcctttacattgacagatgtagaaagaactaatattagtagcgatgcataattaataatattttatcacaaatagaatactgaataaaagcagtctgcctgacatttactggttcagaaaagtcacatatctgcaaacaaaaatagcaataatagctacataggaatggtgttcatgagactctctcatgggacctgtccagttaggttacaagaagcctcttctctacgtgcattgaatgcacatgttccacattaaactttgctgattgttttcttccttcccaaatcatcccacctatacccactaactgagttaggtgatagaaatgttctatatctgtacagtccagtaaaatagccactacggttttgctacagcatgttttgctactgagcacctgaaattcagccagtgcaactgaagaattgaatttttattcttacttaattttaacaatttaaatggctatacatggctaatggctgtgttacaggaaaagacagcttaattctgttctcaaactttaatgtatgtgcaaatcatctggaacctcgttaaagtacagactctgattcgacaggtctgggtaggcctgagagtctgtgtctctaagagctcccaggtgatgctgatgctgctggtgcatggaccacactttgagtagcaagattccgactgcttcaggaaccaccagttccagtgtgtctcaaatgctgagtggatcaattgtctccaaatttttctgatcacacagcgtgccagaaaaaaattcctgagtaccactgtactaacatcttacatatgttataaaacaaaacatacaaaacagaaaatcgtaaacaacagaaatgatgaaataagcaatattttataatgatgatcacagtaagttcacactattaatagctaatacctcaaggcaaaatatacacttgaaatgagattcattgttaacataatggaactataacacacttttcaaaaagtcttcttgataattccaaatttctaaatcagatctgaacaggtaggcattggtattggtgttttttttttttcttttctttttgagatggtgtctcactctgtcgcccaggctggggtgcagtggcataatctcagctcactgcaatctccacctcccgggttcaagtgattctcctgcctcagcccccggagtagctgggactacaggtgcatgccaccatgcccagctaatttttgtatttttagtagagacagggtttcaccatgttggccaggatggtctcgatcccttgacttcgtgatccgcccgcctcggcctcccaaagtgctgggattacaggtgtgagccaccacgcccagcccaacattggtgttttaatctcatactgcgtcccacaaagctcttatgggcagagacgggtcagtgtagccatttccacatgagagagagaaggattttacatttacattacgggtattctcttcaatctgcaatcacttcatagaaattttttaaagccatgtgtatatttcatgagagttaatttagctaaaattacaaaaagcgatccactaattcaccttactgagatctcagctgaaagtgcttccctgaacccagcccttctgcaggcccctcctgctccatacagcacatgtgacctctgacatacacaccaagccaggacaccaccttcaacctgaatgctaaatattatgacacatcatctctctcctaatttttcaataaaatatataaaaatagacacctcagttctccttcaacattaaatatgtctaccccactttggtaaccactgtttagatagtacatagaatttccagaattattatgaagctctcaaataaaatttacctccaataataatattgaacattatgttcttgaaaacacaaggtggaaattcttcttaaattagtgtgttaatgtaactacaatttcaacagagtttaccaggaactgaagaaattatttcaggctttacatggaaaaatcaacgtacaaaagttatcaagatcctaaaaaagaatagtgccctggccgggtgtggtggctcacgcctgtaatcccagcactttgggaggctgaggcgggtggatcatgaggtcaggagatggagaccatcctggccaacatggtgaaaccccgtttctactaaaaatacaaaaaaattagctgggcgtggtggcacgtgcctgtaatcccagctactcaggaggctgaggcaggagaatcacttgaacccgggaggcggaagttgcagtgagccgagattgtgccactgcactccagcctggtgacaaagcgagactccgtctaaaaaaaaaaaagaatagtgccctactggatgttaacatacattacaaatttattatcatcaaaataacatggttctggcacaaaaatcaataagtagatcaaagaaacaataaagaatcaggaatagattgggatgtacatatagaaatcctaactataataaaggtggcatttattcaatggcaaagttaggttaacttaataagtgctcttggcaaaggtggctacctagaagaaaataaaagttagactcctggctgggtgcagtggctcacgcctgtaatcccagcactttgggaggccgaagtgggtggatcatgaggtcaggagatcgagaccatcctggctaacacagtgaaaccccatctctacaaaaaatacaaaaaaaattagccgggcatggtggttggtgcctgtagtcccagctccttgggaggctgaggcaggagaatggcgagaacccaggaggcagagcttgcagtgaaccaagatcacgccactgcactccagcctgggtgacagagcgagactctgtctcaaaaaaaaaaaaagttagactccctgtcttactccctaactaacccactggttctcaaatcggggcagttttgtccttccacagacattaggcaatgtctggaatctgtcacaactgcagggatggggggtttgctggtagaatcttgtgggtagacaccagagagtctactaaatatcctacaatgtacaggacagtcccacacacaattgtctgatccaaaatgtcaatagtaccaaggctgagaaattctatccttacctaccttaaccctcacagctaaacaattaaagaggaatgctattagaagacaggtgccaatgtgaaaaccggtttctccactcatgaaacgtgtggacactggcttggacaagtaccactctgagtctcatttccttcatcttggcttaggggaataaagataatatatatcatgaagcaatgaacaaggactccagccagccacagcagtaaataaatggtagctatgatggctattatcaaaaatgagaaatcatatgaagaagtacctgcaaacacataaatgttctttacaagaaaagggggcattatgttcctaagagatccaggttgcttgatggagtaattttggagacttaaactatagcaatatattacaaattccccacgaacaggaatcgtgtccatctcattctctctaacaaagactgctaccttagcggacccaaaagacacgtaataaatacatttttattttgtttttagggagcagagagaaaataacacactgataatcgtagaaccattatttgcatataatcatttggtgcagaaactgaaaagacccagccagcctgctgaatggggccatttggggagctctaagtggtttgcagttgtagccctatgttctgaaaccagctggggaattagcaaagcttctggtcccacagtgtagccatggggactggggatgttacaaagcccagaaaattctcagaattctctgaggatgtttctataagctctggggcctctgagttgaaagatgatgtatttctgtgccatgagtctcaagatggaacttgagttctatattcaccacacactcccattacccactccaaacttcggactgagaagtcgttaatgacttcttcagcctcattttcctagacataaaatgagaagtggggaatgagggaaggtcatggtatcttttggttacaaaacagtgtatgtctaaaacctctgctgaaagcacagtaatgttttcgacaaatattaacaacagaaacaaccatcatgaggacataatgagaattaattataataccgaaaacatacaggaacaaagcaaagtgctctcagactctcagaaacaggtgttatgtgaatacaagctgctaatttggtttttaaagtctttgtagccattttaagttccaactcatggtcgatgataggaagtgaatgaaatgatgtattcatatttatagcatatttatcatattttcatatacttatagcatctttatagcatttacctctttgtaaatggttccatctttcaatcatttaaaatataaaatttggacagattttagagacaatcattatataaaaatctcatgaacatttaaatcattaataatgtacttatatacatctaaacattatatctcacctacttctgcattcatatctaaaagtgtaaaactcaatgactagtctcatccaggacccatcactggtaatgcccattatatctttttcagcttgaaaaacacacaaaaaaaatctaagttacttctgattgacaaagaggaaaaaatgtcaattttcaattcaacagagttgaataggtagactattcaatacaagactcccacaaagatttaaagtaagacaatctgagttcctatatttaatatgagacagacatataaatagaaaactccaacgctttagtaaaattatttgcaactaaattacctacacttatgcatacgattctcaaaatcatgtccctgtagtctaccttgcaatgctaccaaataaatcttcctagagagtcaatttttacttaaagattgtatgtacatgtgggaagagggggcctctattttatttaaaaacaaatacagacatttcatggtactgaagtattcacccaagttttaagattaacaggaaatttcaaagaaattcagtgcttgtgcatttgtttgggtacctgctcactgttctctgtcatttcaaaatagttctggggagagggtggaaatcactagtgtgctaattctctctctcagaagaaacaaacaaacaaaaaataaataaaatgtgaggaaagacacaggccaatcaagggcagctatagaacaggagtggggaaaatgagctctcacaccaaccatgcacgtctccttcttgttctctccaccggggtaaaggccaatgctttggaggaagagaacaagagtaactcggcaagccatttaggagtgtggattggaaaaaattctttcccccaagagaaggtggctttacgctggcatatgagattgaaaagtgcaaacaaataattaacggtgaatcctgaaacttcaacacaccagaaaagggtgtcactccagagtgagatgggaaaataagaggaataaattaaggtagtcttggtgatgctggacagctcctcagggggtacggtggcagcccggagagctaatcaaatcctccacacccctcaggaagctagagaaaactgatgaggaaagataccacaccagaaacgaggggcagctgccagcaacgggtgttcgccccacctaaatcggaatccaaaataacgacccacatgctaaacaaacaccttctcattccccgctctgccttaagcaagagctctgaattcaccttcctcaatgtctgctctctgggaataaaccggcggctgcagtttcccatcacagtagcacgcatcaatcagtgctaaacccaccgttactttcttccccacgtgtgattccaacaatcagcgcactctagggctgatcctcggcctcgcgtgtgaacattttctagggcacaccccagtaggcgctaccaccccctgtgtatttcgcttaattatgaaacctctttctagaagccctataattctcccaagagtcaaggtaattggtaaaaattagacatgaaaagacacaaggccacttaaagaggacactttcgactgtaattttttaaaggattttctttttagtttcagtataattttgtactttcccaattttgcccttttcaaatgccaaagaaaatgttcatattatcttgtaggctataaaaaaaagataacataatgcatttgtacttcacttatggtccgcaaagatttcctttctttgaaggccatcctttgaatgtcttttaaaagaaaaagaagagtgaaaaataatggacatctattcttgtggcaaatcactgttattttggcaatgaaaggatcgtgtgtgtgtgtgtgtgtgtgtgtgtgtgtgtgtgtgtctgttccattacttgaggtctgtgctatgtggctgcattattaagatatacttttggtactgataaatacgtaaaccaaagacagatctatctcataatgaatttatggtcctttagtaaaagattgtagcaaaattccagggcatggttttatcccactcaattcatgcaaaatctattgagcaatatctattcaaggcctggcactctgagcaagcaatgggaatccaaagatggaagaggattcagcaaagggagtggaggtgggcagacatctaaaacacaataacaggagagactgagattccagcaattgctgtgtgtcgaaggcaggataagcagctcaaagggtgtgtgattacctctactgatgtaagcactacacagaaatcttagaggctgcaagatggcagccagtggcatgggttagggacaaacaatcctactttggaaaagtgaggctaaaagagaagttttcacataaaaatccagatttctggcttttcttgaaaaaagtacaagacctggcaacacctgataaccataggacagagctaaggcattgactcactacttcccaagagtccccattcaatgagccaggccactgtagggatctgagcttgcaagccctgtcttagaataaagacagagtcttcagaattttagattctgggtctcaagaggagaaacaaagggtaagggatgagcattctctgagatttactttcctggaaataaaacagcaaaagccaaaagaatcgtttctcttgcatcacttgaccctgggtggacaaggctgactcattcagtcatctgtgttgctcgtaagcacttgggagtacagcttgctgatatggcctaagaggaaacatttcacagactccaagcatatggtcaatttgggatgaagcagctcaccgtaactctcaacaacccactgcatctcttctaagaatcactggaggaatctgttctagaacaaggactgcagtagccttggctaagtcagcagctagagaagtgggccctggcctgaggggctcattacagcaccacacacagcctcctccaggcttctcatgcctgccctcccactgtttctctttggacaccacgttccacttgttccacaatgtcaatagtgggaaggcccttcccactttttcactccctattccagtctacccatcatgcccaacctagagcaaatgacagccgcagagcctcctcttctaaagcactctcattaacaaattccaggttagagatgcaaaccaagacctgtagacttacctgggcaattatataatttgcacatatattttgcagctccctagtagatagataagtttcttgagatctaggagctccttagagtcatctttgcatagtgaaattacatatacatatttaccttagaaaaatccaaacaaaagggataaatgtttaccacttaaaacagtgccagttattctattcaataggcagatgtgccccagaatgaactcgagaagggaggcgtggagttcctgttccctcaatgccaattcccacaaatgcttccctaggtgcaaaaatttcaccatcctaggtgtgattccaatgagtactcactataaacccaaaccagcttacctccccttggggttcactgttggaaaagcaatctgatctagtcctgaaggaagacatgcattggtcaggtagagagatgccacagtattacattttatatgcacttcaaaagattttcaagggtaactttgattgtacacattttccaccttccacaagaattttagaattgcagcctctgcattaactacaggtcctctgtgtgcccccaccctaatcctaggccaaaaggtgcctgataaatgtccacagagctccctagtatgctggtccctgtaccatgtaaggcattactctacggaagctgtcgccaaaggacttcaactcattcatgatgaaaaacacaccaatgacgcccctagctccatgtgtgtacaacgacaattcaacagctgaaaaatggccagcaccatgcatttttgtactgcagttacatctataaccataaaacaacctagaattaaacccacactcatgaaacatcagaagtgacgttttaataactgacttctgttagccatcaagtttcaagatctttagcaactcattctaaggaaaactacttgaaaaaaatgaaggatcacttaactatacttagaattcagagtgagtgcaactatattgtctattaaaaatcactaagtgttccaaagaaagagttgagaaaatgaagtacaaactctctttctacttattcactaagtatttcatattcagctattcattcttgagtcaaagtaacttgagtcaaagtaactgacttgactaaattcaatacacttagaattaagaacagtttacagttagatgtgtggctaggcctgccatggtaaaatgaaatggcagttattagaattttcagaagaaaagatcaggtaatttttcagggatgtaagtgaaatctgtcaaaatggcagtgagctcagaggaatgttactgcacttgagaactacttttggaatgactcattaataatttagttagactgtcaacgatgctctccaattactcaaatactactagaaaacatttcattaggagatttaaataaactcttcctgcctcatgctcattactccccatgtttgcccaaaagaaatcaggcccaagttaaaagctgcccctccagaaacatttccttggtttcccttccagtgagaggtggcatctccttctcccaaactcctgtggcatgaggcacatatctcatttacttaattagactgcaagtgcttggaaggcaggctccacattcaactgagcctggcatttgcactctctaacttcccaccacatagagctcctagcacaatactctgaaaagagtactcactcagcaagtgttagtgaatgagtgaggggataaatgcaggcttgaggggttccgtctggtgtttctggcatatcccaaagcccagttatttgttaaaaattttatgtgaaccctccaaacacattaggttgatatcgaagtttcacagagtcatctcatggtgattcttggtaatgaagttcacttgggtcaacaataatctagaatgtgtatctacatctctttcaatgtgctccacttgaaaaatattaaccaagtatttctttctcttttaaaagctaactcatttcatttaacagcatctataactgtcagaactttggcagactttgtgaaaagtatcactttaactgtctgaattaaaaattaatcacaaaagtcttcctttgttttgtttttactacttaaactccctattgataaagaaaaagtccgttttttttttgttgttgttgtttcttgagacaggatctcattctgtcacccaggctgaagtgcaataacacagtcacatcccaggagcctccagctcgtgggctcaagtaatcctcccacctcagcctcccgggtagctgggactacaggcgtgcgccactacacccagctaatttttaaaatttttagtagctactaggtctctctactttgcccaggctggtctggaacttctgagctcaagagaatcttctgccttggtctcccaaagtgctgggattataggtgtgagccactgcacctggccttgatgtttttttgtttgcttatttttaagatcgttggagtcttttccccataatacaaaaaaaatgcagttattgcatttgctaggagagaaaattcctgtactttaaaattatattttacaatgactgcttccaacctccaccactcctcccacctaataccattggggctagaagtggggatgatcctcttgatcatttttgcctcattttacatgataaattatcaaacttttgcatttttttaaaaaaggcagttccaaagactcaacacaaagttacctaaggaatttccttctctggatctgcttgtccaggagttgaaatgttcattaagttcatcaggcaggcagttcaggaactctggatgaaagtcagctcaaacccaaggagactgccaacttccctttcttgaaaaccctcctgcatacaaagtctcattcctctcaacagtttgctcatttttgtcttctggaaagtaagttcatttgttcatgctacgttagtggaagtaaacaacccctactgagcccccagcttcactgctggcttataatgcactattccccaaagtggtggttcttatttctgaagacgggcttcctcacccatcttgtcccatcagataacttagagtttggtgcaagccttgcaaatcatgtagtaacagcccctcattgtagcagctagaatacggaggccgagaaagatccatcgatgtgccccttgcacgacactgcttactagtagccaagtgcagcctagaacgcaggcctcctggccacgagttctgtgttctttcttacctagcctggtgcttacagctctcctaggagtaaagtggcaagccccaatagtgttgctgagtgccaggcatgaagccaggcaagaattaggtcctccacacacttgctactcaaagtgcgtgccacggaccatcagcatctgccccatctggaaacaagttagaaatgtagagtcccaggcctcccctgagacctgctatatcagactctgctctttaaccatatccccaggagactcacaagcacattaaagtttgagaagtgttgctccacagcagggagaaaaaaaaaaaaagatacaccttcactttttgagttaagctcaggccaagtcctgagctcatgtcaccgcctatggcagatcacactgaaggatgtgccagtgatctgacccaaatggacttgtctcctttaaacactaaggccactcggataatctgcagaatagaatccctggagcccagtggatgccttatagaatccatacaactcatttgtctgttttgtttccttgctgaaattctgatttacttactgactactgaggggtaaaatgggggaaaggttgagtaataaaagtacttctttatggaagatcaaagatatcctcccccactttcttttcctaaagtggttctccacaagaattgtgggtaaaggaactcagcacgtgcttcatgccaggattaagaatgcaggtacgggagacagccttcctgggagcaaggcagaactctgcttgctgccatccgtgtgaccttgacaactcaacatttgtgtctcagttttctcacctttaaaatgggaacaaagatgacacttatttcatagccatatgatacagatgaaatgataatgatcaagcctcacatacagtgagtgctcactaaatataagctactgtcattatacatatcctatgtgtcagtgtcactcaaaaccactgtggcccccaatcttctcatgattgacccagataatgatcaacagccaatcaacctaaaggaaccaataatggactgggcgtggtggctcacacctctaatcccagcactttgagaggcctatgtgggaaactctcttgagcccagaagttccagaccagtctaggcaacatggcgaaacccggtctctacccaaaataaaaaaattagccaggcatggtggcgtgcacctgtagtcccagttacctgggaggctgaggtgggaggatggcttaagcctgagaggcaaaggttgcagtgagctgagatcatgccactgtgctccagcctgggtgacagagtgagaccccatctcaaggaaataaaaaagaaaagaaaagaaaccaatatgcagccaggctcagtggctcacacccataatcccagtggtttgggaggccaaggtgggaggatcgcttgaggccaggatttcaagatcagcctaggcaacatagcgagaccttgtttctacagaaaaaaaaaagagagagagagagaaagacaaactaatacacataaaaggcagacactgagaaaagtcttgccctaccaaaacatgtgtgaattctgggttcgagcaaaaacatgcaccacctttcactttgaattctaatgtgtgttgacgtaatgtgtgttgatgtagagtaagagccccagagcttgatcaaccatgaagaaataaaggaaaggaaaggaaagaggagtcagtcttagacacgcaacctcatgcctcacagctgtcccttatgagcacaccagccaaatgctttgtctacctgcaaagtgactttaaaaggagagaacaaggaggagctgctctgtactccctttttaaaatgtggcacatgctgtcattccttctatgatagttggccaaaagacaaatctgatttcctttcccagacttcattttaatttttatttttatgaaagcaggaaaaacatactgctctctccatcccatcctcactgttttttttttttaaaaaaattaatattgttccttttgaaagactaaccccacttctcttttcttaattaggctcaactgaaatataggcataagcattcaactgggcaagccaaactgaaaaacatccccaagccctgaaaatctaaatcaagaccaaaccaattatagcattttatttaggtggtgtttattttttgtatttttttaactgtcaagtgattgacagaatttatggtaggcgcaaaatgttaaagtatttctagactttgcgggaagacattaagtttgtctatagcctctaaacaaaattatttgttttccagtcatgcctttcagtttaaaagtattgcacttttactagccacatcattctgggcatatgcttcttctgaggagacatttttctagctgagtttaatccagtgagttaaaagagggaaagaatgtaaaatggaactctctacttgcagttggacatgcatttgtttttcatcgcaggatgctaggaaagaaacctctctggttgtctaactgtttgcctcacctgtctgagggctgaggccctgaggacagcatgcaaatttcaacccccaaccccatcctctcacttcccctcctctattgagcataacttagccgcaacaggatgctacccattcacccgtggaggccttacctgtcggttttcttgatcaggatggctctaaagatgtgctccaggggcgtcttctcccgctcatgggtgggctgcacgaaggggtgcagggccgccagcgagaagccctgctggtacagctccaggagctgggcgggcaggtcacgcagggaggccagcctcactgctgaggacccagggagctccgctggagtggagagaggagaggctcatcaaagacccatcacaacgcccactcagccctgcccaaacccctcttcccttgccctcggggaggatcctctaggtcactgctaaaatgagtttgtcccagtttttactgtcttcaaacagactttataagcagcctgtcgttttccaaatcacccaaaggcattaataattggatgtcggccaggcgtgatggctcaggcctataatcccagcactctgagaggccgaggcagatggatcgcttgagccgagaagtttgagaccagcctgggcaacatagtaaaactcggtctctcttaaacaaacaaacaaacaaacaaacaaacaaacaaaaacaaaaaaaccccctcaaaattagccagtgcttgtggtcctggctactcaggaggctgaggtgggaagatcgcttgagctggaaatggggaggtttgcagtgagccatgatagggccactgcactctagcctgggcaacagagcaagccactgtctcaaaaatgaaataaaataaaataataatggactgtcttagatctagagtcgtcttatcagtgatcacaatgaaaaagtcatttccaccctctaaaaaaaaacacacagaaataaagaaagaaaggaagaagggaagggaaaagaagaaaaatacattgagcaaatataaaaatactaggtggcaaaaagcagcataaacaaagtcaaaagacaaactggaacaaaatttctgtgacccttaagacaaagggctaatttccttaaatttgcaaaacactccccaccccaaaataatttttaaacgggaaaaatatatgaataggcaattgccttaaaagtgtaaaaggctaaccaatatttgaaaacacactttaattcagcattagaattacacaaataaaaaccaggaatattttcacctattgaattattttaaaatttggatttttaatttatttatttttgagaagggcaaacaacgttcaaaagtcaaaaggtacaaatgtgtattcagtgaaaagtctacatcctagccctatcctctacctcctacatttatttccttagaggaaatcagtattatctttttgtgtgtatatgcattaacaatcaaagaattcatacaaaagtgaacaggtctatatatttccctcctcttctacacaaatgtcagcataacattacacacctagctttttagaatcaatttttatcaattaacagtatacttttcggccaggggcagtggctcacgcctgttatccccgcactttgggaggccaaggtaggcggatcacttgaggtcaggagtttgagaccagcctggccaacatgatgaaaccccatctctgctaaaaatataaaaaattagtccggtgtggtggtgcatgcctgtaatcccagctactcgggaggctgaggcggaagaatctcttgaacctgggaggcgaaggttgcagtgagccgagattgcgccactgcactccagcctgggcaacaagagctaaactccgtctcaaaaagcaaaaaaacaaaacaaaacagtatacttttcttaagagaccatttcatagcagtacacagagtgctttctcattcttttctacagatccattgtgtgatataccatggagtatgcaaacttttgctcttacaagtaatcttttagtgaaaaatctcattcctacatgattttgcatgtgtgcgcttatagtacatatacaaaataaattcctagatgtggaattgctgggttaaaaatatatgcattgtgtgcctgtatcaaaacatctcatgtaccctataaatatatacacctactatgtacccacaaaaagtaaataaataaaaaatcagagatgtaaatatatatatatatatatatatatatatcacacacatatgtatgtgtgcattgtaattttttcagctagtgctatttcccccatagagtattatggatttatctgccatcagtgatgtataaagttatttcttttcccatactctgacaattctcagtggaaaaaaaaagatccctgtgacatggtaacttatatttatcttattatgtaatttgtattttttcttattaaacatttcatatttaaatgctgtgtctccttgtctgtgaactgtctgtccattatctttgcctcgtgtcctatttagtcattgggctttttttctattggtttgtaagaactctttacatattaggaaatttagtttttgatgtatctgcccccaatttgttgcttgccttttgactttgcatatagtgggttttgccatgaaaaaaaaaattttttttttttttttaagacaaagtctctctctgttgcccaggctggagtgcggtggtgctatccccgctcactgcaaactctacctcctgggttcaagtgattccatgaaaaactttttaaatgaagctgaatttaccaatcttgctttcaatggcttctgagttttgtgtcatagcagaaagacctgggattataaaacaattctcttgtgaattcccataatacatatttcattttttgcatataaatcttttatcgatttggaatttatcccatgtaaagtgtgcaatatgaattgaacacccccccaccacaggggtttatccatttttcctcattgatttgagatgccatatatcatatgccacttatcatttattatattcccaaatatgagtttatgactgtgatccattaatctatttgtataaaacactacttcaaacaattttaatttcatattatgttttaatatctggttaaactacttgtcaaatcttcctatattcctgtttatattttgaattttcctaattcgtttttctaaatgatctttaaaaatcagctcagtaaattccccttgctccactaaaaaagtctgtgggtatttttattgggtcatgttcaaatcatagcttgactgagaatgaatattttcaccatgctacaagttcccatgcaagaaactggcaaaattttgatttggtcaagtcttcctttgggtccctctggagcatgctaaagttttcttcacacagatagcacatatttatcaggtttattcctagttattctatattttattgctattggaataatacattttcctttttcacttctgtaatattcactgcatgcaagggtgttggggaaacaggcatggccctcatcgtggtgggagtgaacctttcttgagggctgttagagcaacctagtagtaaatacctttgtccatatatcttgaaagacattcatgagtccagccatagaagtactaccagtagtagggttgctggacaaagagtgtgtgcatttttaggtttgaagggcaataccaccctgccctcaaggagaatcgcttgagcccaggagtttgagactagcctaggcaatagggcaaaactccatctgtacaaaaaaatacaaaaattaactgagtgtggtggcatgtgcctgtagtgccagctactagggaggctgagatgggaggatcacttgagcccagagaggtcaaggatgcagtgagctgagatcgcaccactgcactccagcctggggtgacagagttactaaataaataaataaataaataaataaaagataggatcggtgttttttcctttcactttaagctccaatacggcttgcacaatactgtcactgatcttgtctttatttattataaatgttgcctcactcccctcaccctaatcctggcccagcccaagatctccttttgtcctcttgtcccagagcctgcaaatgctgggtgtcgaccttatggaaaccaggggctgtcaacagattacaaggctgctgaaccaaaagggcaaaaccacatgtggcggagacagtttgttttatttgaaaaactgaatgtacttttggtaggagtgtagggctttatggaaggcaactgcacgttgtcaatcaaacctaaaaatactatccagcaccaagatcccctctcctttgataaaactatatacaaacagcatctgtgagtcatcgaatatgggccctcaaactcatatttaactcaaactcatattggtctctacagttcaatattctttaaatgattcaaatttttcaaactcttcctgctataataaaataaacctttattgagagtttgataatttatacatttgtttcctcttatgcatcacactaaaataaaaaataaaagtagttaatatgtttagaagacagggttcttgctgggcatggtggctcacgcttgtaatcgcagcactttaggaggccgaggcgggtggatcatttgagagcaggagttcgagaccagcctggccaacatggtgaaaccctgtctctacccaaaatacaaaaattagctgcgcatgttggcgtgcacctatagtcccagctactcagggggctgaggagggaggatcacttgagtccaggaggcagaggttgcagtgagctgaaatcgtgccactgcactccagcctgggagacagagtaagaactctgtctcaaaaaaaaaaaaaaaaaaaaaaaaaaaaaaaaagaagacaggtttctataccagctgctctcctcactgcctgctaaccccagtcatgtgaacactcaatttctttgtataaaatggtgataacaacatcaacctgtcttccatcatagcgtcattgtgaggatcacgtgggatgatgtgtgtgtaatctacagaacacaaaacaatcacaggcggtggcactggctgtggtgaatgggaggactggtcaccccgggatggtgatgacaacatgatgtggggccatgaaatccttccccattcccacccacactccttaacctccatgctcccaaatcggtgcactaaaaatgttagtcaatcaaccactttatatttaaatgcttcctgaaaaaaacataataccttttaaatttttatcttaaaatctaaagatgtatctcctgtcaaagctgagcaattttgtggctttaatttttggtatgcatgctgtcaaagtaaatttagcttcatggttaaaagaaacaaataaaaatgaatctcaatgatcttaaagcaataaaaaaaggctcctattataaacatgattaaaggccttaatctcatgtttctatttgaaccctaaccttaaaaatacaaaagaaaacatagttcttatgaagtgaccaattccccagtgttactcctaggcgaataaacaaaggaatgatttctccacttggatggacataccagttgtagcctgttggtctgtttctcaccctacttatcagagtaacctctccactattttgttttgtaatagttgcctgatttcatttacaaattatgtaaccttgggcaagctatatagctccctccccatctcttgggactctcatttacaaaatgaagactttggatgggcaattgcaaaaggcgctttcaactttaaaatgcaataattttattatttcaatttggaggctgaggtaccagtttctaactaaaaagtaacattggataatataacaattgttttcaatgttaactaaaagagttcccccaaaccagagctagaattggaagaaggaacacccacatggcatgtgtgggtggctggagtgaggaaggagaggctggaagatacccactgccagtgggcgggagaaacatcactgctgcccgagggttccagccttctgcctgcccaggcactagggattctgggctaactgtcctctgggggagtgtggggagcttttcagaggagttctagggaagagatgcctgcccagcggtgggagagaaaactaacgttttaagtatcaaggatgatgggtctccttcaccctagaagagagctacaaggaaacggcatgagttattctgtagttactttggcttcctggcctttgaccaggagctgactctaaggctgaaccacatgaaccgtctcatcataagttaaaatttctaattataacttcgtagtctgaagataagggacactggtatggctgtcttagccaccgttaccttccaaaaagagaaaatgccagcctactcagagtgggccgctgccgcgagggctgatcacactttttctccactttctaatctgtcaggttctatagtttttatctacagtgatcacactcgcctcatctgggaaggacacccacgtgctcccacactgccacaatcttggctcactgaaacctccgccttctggactcaagtgatcctcctgcctcagccccctgagtagctgggactacaggtgtgcaccaacatgctcagctaatttttgtatttttagtagagtcagggtttcactatgttggccaggctggtcttgaactcctgcccatcttcatcccataccagggctttgtcctgctgcagtgcaaaggacaattctctcctggcttctcccctacctgggcaggggcagagtctcatctccttactggacagagggcttggtgcagatcccaaagccattaacagaggtatctgcaggccaggaaaataaagtaaacaagagacatgagccagggggacagcaatgaacaccgaggccccatcttgcccaaggggacaagatggttactgctaatggggggggggcccaatggtgccagaacttctaactcttactttcaagaagtcagaaatcttaatcttcctaatctttaaatgtgacaagtaactgtaatttttttctcaatcccatatggccaaagtcaagacctagcagcctgcagagtatggatggggcatttgataaagttgggggatggatgccccgcacttcttcctatttctgatcctgccactgtccaggcgcagtgtgagcatcagtcatacatggaggaggatgtcattctgttcatcccacatcatcacaaggtacatcaaaagcttcaaggacacatctgcaggtatttgatactggcctctatttcctaattcctcttttttctatattggcactgagatgaacaaaaagtttagaatcacatgattgcattttgaatcttttggaaatatttttttttattccagactctattaccaataacaggcttttataaaatcaaaatatagaaactactgctgaaaaggtattttgggtggcatgagagtccaaacgtcttttgaaataagtgttttgtttttctttcagaaaataactccatataaataaataaaccattattccaagaactaaaaaaaaaaaaaaaaaaaaaggaaaagaaaggaatgaaaacagagaaaaaacataatccacaaaaccacacatttcttaacactcctgggataaagtaaattttgtttttgctatgactatgttttgtttagcaaaaacattccacagctccatttattccctggaaacgaagcccttcagacatttgcaaagggccaaagtgaggtctttgctatttcaaacttgattattgggaaagtatcagcctccaacacaagaaagaaaccaccgcatacagcaactgcccatttcactcagctctgtaaagcaggaaacagcaggctgaactgcaacagcttctattattttgcccagaaatcatttgtgactttaacctaattattcaaagtctgactttggtcttctaattacatccgctaatggatctgtcaatacgaaggagtgcaacatgagacagacaccaattccctcgggaaatttccctcacaggtgaagctgataatgttacactgctcaaccaaatctctcttttttaaaaagttccttcaagactgctagtgccataacatcaatctgcctgggctttgcagtagatccaatttagcaaaacactaaaatcaatcactttttgatgcaggactttttattgtataggtaggaaataggagtccaatttttaaaataatgtttgcagaagacaaagcccatgtcttctgtatgtgccatttctaaatctgtggaataagttaaaatgtttgttctaagggctttaaaaatttagacttctgtcatcttctcattaaacaaactcatgtatctgaaacttaaaaaacaaaacaaaacaaaacaaaacaaaacacatatccaggctcaggagaccacaccattaaaacactatttttaaaatttgaagtgaaatttccataacataaaattaatcattttaaagtgaactatttggtggcgtttagtatcttcatgatgttgcacaaccatcagctctatctataggttatgaaacattttcatcacccccaaaggaaactccatgtccattaagcagttactcttcccattcccctctctccccgagccctagcaatcaataacatgctttcacaaaaaaaaactattctttttttaaattttaatggatttttgttgtgtatattcaaggtgtacaacatgatgcctcaatgtatatatacttagttcaaatgattactacagtcaagaaaaccaacataaccatcatctcacatagttagttttcttttttgtgcgtggtaagagtacctaaaatctattccctgagcagatctccagtacgcgatgttattagctatagtccccatgttgtacattagatctctagatttacttatcatacataactgcaactttgtacctttgacctacaactccccatctccctgcatctccctgaccccccaaactacagttctactctctgtttctgtgtatttgatttttagtttaagattgcacatatatgcaagattacgtagtatttttccttctgtgtctggcttatttcacttagcagaatgtcctctagattcagccatgctgttgtaaatggaggatcatcttcttttttaaggctgaataatactccattgcatatatataccatagtttatttatccaatcatctattgatggacatgtaggttgtttccatatcctggctattgtgaataatgctgcatggagtgcagatatctcttcaacatactgatttcatttcctttggagaaatacccagtaatgggattgctagatcataggatatttctatttttaatttttgatgaacctccatattgttttctataatggctgtactagtttacattcccaccaacggggtgcaagggttctcttatacttcacatcctcaccaacacttcttatctcttgtatttttgatagtagccattctaacaggtgtgagctgatatctcactgtggttttgatttgcatttctctgatgtttagtgatgttaataagcattctttcatatatgtgtgggccacttttatatctccttgggagatatgtctattcaagccctctgcccatttttcaagttgggttatttgtatttttgctattgagctgaatgagttctgaaatactattcttaataccttaattaaaccatggatgaacacacaggggaatctcagtaagactaaaagaacttctttaagcttatataaacctaagattctgcaggtcaattagggagtaactggcaaagcaacagatgcctcatcaaatgaattaagttgccggccgccggaccacaaatgactgttaaagcatcaggctgtcgtgacaatgggagcggggaagagttaagttgttattggtttgctcgtcatttcagagaatcacacatagtcaatgaattacacacaacacacacacacacacacacacacacacacacaccactgtactgtaaaaattcagtgtccaggtatttgtaaggagactgactcaacaatttccattgactgcatccattaataaaactcagaagatggcattattgttcacctcaccagtccattttgtcagagaagacacaggctaagatacatcaagaagcctttttaagaaacaccaggtcccctgatgcttaggtttagtagtgggcactcaaatattaaaagcaacccactagatatggaacctggagtattaatacaatatttcatacatttaaaagtacttttgttagagaagacacaaaggatcaccaattattcagaatcggtaacgaaactcatccataccaaatccaagaagagctttttgtgagtcagaagaaagcaaattatgaatgttttaagccattttcctaatgagtatgatagctggcattcttggtagttctcttgattttgagagtacattatgctgatggcatcaaagactagccactaatgagtatgtacaaacaatataaaaattaaactactggatttacaatgtaaaatgatttgtcatagaaatcctgtatggattttctattataaaatcttaagacttaatttcttcatatccctatgggttttttccaggcgctccggcttcctcccacatcccaaagatgtgcatgttaggtaaacagccatgtctacattgtcccagtctgagcaagtgtgagtgtatgtgtgagagtactcctgcaatggaatgacatcctgtctagggctggcgcctgccttgcatcctgagctgctgggacagactccggccaccccagacactgaactggaataagcgagttggaaaatgaatgaaggaatgaatacaaataattgtaaaataaaaatgtgtaccacaatgtaccacaataaacaatgtgggatgaaagcacttggcgagcccaccaaatttgttattggttttgaacttcgtggtgggagtaagtgctccttacgagtttcactttgcaaacatttattccttgatttaacccaccaccactacaaccaccatcactcgctgttttaccaaaaactgggtaagtcatcatcttatttgttgttattaatctttcttaactgtatgtatagctcacatttatttccatgtttagtattagaaatgttttggtctttatcgagaagtttggtaatgtttttgtgaccagaaatatgccataggaatttaactcttgattttctcaattagcctatggtaaaattggtttcattacacactgtttcatatacagttgcagtttccaagaacctattaacaatgttaagtgaggacttactatgcagatgtaaacagttccaaaaacaatgctgttgcagccaagctcttagagaaaacatataagaaaaataatgcatctttacaaggcacttttgaggagtctcagtttcaactaagagtatgattgctctgataccttctcatgggcctcacaaattcaaggaagagaaaaagagaaagaaagagagagagacaaaaaggagatatagggaggctttctttatccacaccgtctaaggatgagtccccctccctcatccatacaattctctctcctgctctttctctttccccccactctgtctctctctctgtctgttgccattttttctttctctctttctctctctctctctctcacacacacacacacacacacacacacacacacacacagctctctaccagcgctgtccaagacagtagccacatgtggctattgagcactcaaaatgtggccagtctgaatgaatgtggtataagtataaaatgttcaaccaatttcaaagatttagcatgaaaaagagaatgtaaaatatctaagtaagaagttttttatattaataacactgaaatgacaatactttggatatattaagattaaataaaatatattaatattaatttcatgtgtttctttttaccttttaaaaatgtgacttttaaaaagtttaaacttacatatgtggctcaaagtatatttccattggacagctctgttctatatcattaattaccaatcatttgtttcacagcatctatcacaacttttaattctacaaattgttcattgaagtttttttttttttccctgtcttgcctattaaataatttccactgggccagaacccatgctgggtttatttgccaacaaggtggccaaaccaagagtgcctggagaaggctcattagcagctgtcattaaatgaagaaattctcctctgataaggccacagtccacatcaggactgcagtagcactctctccgtcaaagaaagtccaatgcaaactgctacctgcagtcactctggtggatggtgaactctggggtccccatattccctgggccctaaagcagattagccacaagaccaagatgaaagaaccataatgagtcctggaaaagagtcagccagtgtaaagctcagaggaaacctagaaacctttaaaaaaaaaaaaactgtggtaaaatatgcctaacatcaaatttattattctaacaattttaggtaccgttagggaaattcacattgtcgtgcaaccatcaccaccatctatctccaggaaatcttcatcggcctcatctctcggtccacgtccaacaagcagaagggacacctcactttcaggtcaccaactatccttctctgtctctgctagtgtgagcaggagttacaaaagcaacaggaagaaaaaagctgctgagttgggataattcaaaaacatgccactgggaaaatcaaaggttgatatgacaacaaaagcaaaggaagaatgtaaaaatttcactttgtaaagatggccaaataataataggacaaagaccatggttgtatacaagacagtgactggaaatctcaactccaaacagcagaaaatggaaaacaagagatttcccaaaaagtgcggtacccgagggtatgagcacacttgagtttggcatctacacaggaaacgaggtcatttctttttctcctgagttattatcatcaaggtctcgactctgtaacaaaatttcacactggtttatcaataaagtcttaggtgaattttcaaaagcttctgaatatagtaatataaaatgacaaactatggaaactattggaaatcataaagaccacgtgtaagactagtttcaagaggcttatgacagaataaattccacactctgggggcttggcacaacttctatccacaaaagaagaccactcatttgttcaaaggcaccaccccaagacacaccagcaaattcctatcagtggattctccttttcctcactgtagtgtagacacaccatatattcagcagtgcagccacaaaaccattcactaagtctacataaagttctatgcattgtaaatgcattttaacaaataatattcctctgtcttatgacatcacaaaagattcaacaaaactcagtcaaatgagaacaggaccagacagctcttgttctctaaaacaggcttccacagctgcattttcagctttgcatgaaggattaccgccttcttgcataaactcccaaattggtgcatggaaatagaaaatcatacacacgagttgagcagctccggctccattaaccaatttgcatgcaaaatcgacatcagcactctctggtctattttttgcctatgtaagagatggcatttaggatgccttgggattctgcttttcagaggcattttggttcccactaaagaaaacggggtccctaatggtgtttgggggcacatgcacatgtccctcccagctgccttctcaggcattccagtgaaaaagagaaaagtttgagaatgagatcaagtaaacaattaggtgagagccaatggtcagggggatgttcttcagactaatacaacgaagcaatcaggtgaaaatcatttctaattacacccagaagaaaaatacgatctatccaccgttggcacaagaagggaaagatggatttttaatcaggcaaaggaatgtactttctggacttgccagtgatcacttactgagatgggccatggagaagtctggcctttgaggttacgcatgaggatctgataggcatttgtgtgcttataaggaatctttagattttctctaatgtattatttcttccctctcttcctctctccttcttttctctcttttttcttttcttcctcccttccatccagggagccaccagccacatgtggctatcgagcatctgaaatgtggccagtgtgattgagatgtgcccaaagtataaataaatacacacaggatttcaaagacttggtaaaaaaaaaaaaagtctcccaataataattttttattgattccatattgaaatgataaattgtctaagatattggattaaataaaatatatcatgaaaattaacttgcctgtttttattttttaatgtggttactagaaaatttttcaatggcattcacaagtcatattgtatttctattggactgctctgtcctagaaccttttgttttaaacagatgcattttcttacagtccaaaaaaaaacatgatcccttgttgacttttatggaggtgccaatttaattcctttttcaacattctttagctacagctatgagttgaggtcacttctttttcccaaaataaatccataacaccaaggaatggggacaagctgtcacaacccttacaatgtgggatcaaaagagtaaccttccttgaagcacattaaattttttttcttaactaactgtcgctattccaaattggaggaaaaaaagtacaactttttactgccttcatgtttgatggtttgctccctgtgtcccttaaatgcctgctcttcaagaatctctagtaacacaatcacactgcttctaaaatgtttacctctcaggagccactgcgttcccgaccttcttctgccccattggcaggccccaaacatcctcctgagtcacaagtctcaccccatgcggggattacaggctgcgactcactgctctagcaaaactagaaataactgctggaggcaagcagccagccggcatcccacagagattattcatagcagaaatatcaatagacagtaggccctccagttggttgtgttgagtccctggaaatgctttgtactgaattttccagatgatttatgttatgctccagaaaggcaacatctccctcacacacttaataaatgcatccgtgtggtattaatgtttcaacttaacatagttttccccttcctgtactttctggtctggttccttggggagtggagtgggaaggcttcatgatatctgaaatccccacaaattcatacgaaatgagtaggattattactttgttttaaccagagtgcattttatcttagttctaaattatgcagatcctattaggcaaataaagaacagaaatctggaattgaattataggagagaaagctgattattcatcaaatctggctcaggcagatgggtggtgtattggctccagttcctaatctggaccagattacctgggttcaaatttcagtgccatcccttactagccatatgactttgggtgaattacgaatgcttatgggcctcaatttttgtctacagaggataaaaataacacctttctcatcaggctgctatgaagattgagataatgcacataaagtcctagaactgcacctggaactggtaactcctccatacacgggagctgctaaaatcattgttgttatcaccattatgcataaccctaatcacttcacacattgttactaacgtgacagactgtcatgtccacgagttgatccttaagtctcggaaccactccagctctgcatcaatattcttcagctttcacaactgactttgatttctcagtcatttctgaatgtgagccaaaaatggtctagaacatcaagactcagaaaaatcaacgagacaaaagccatgctgacagactgctgcctctgatttgcactgaactccactacaggctgctgaagtacttgtggaaagggatgtgaggaggaaggggcagggcgtgtctgcaatggaactgcagaagcctagagagctggttctagaaaatggccccatctctagaagtgaccaggaagcagcaggaggagggctgcaggaggccccagggaggcgcagcaggggaaagaggtggaattgcggcaggaatacattaaggacatagcacacaaagcaaaggcagaagacatgtcacccccatcctgaccactctccatgcctgtcttaaatccatcccaatttgtaaaattaaatgtgcaaacagaaaatatttctctgaaagagtcataaaatgtcagcttctccactttccttcctaacccacaatttttaatttcctctactaactgccagaacaagggctcatatcttaaattctcctcccacctcaggcctgccttgcttgcagctctgtctgggagcatttcaggcaaaacatttaaaatgaaaaaataagccccaaatgtctatccttagctatggcatagaaaggggaggctgaagagatagtgtctggccacatccaggtgcacagaggtggtggcctcagagaaggaaggcaggtaggataagagcctgaggcccatccaagggctctctcccactgcaccatgatgctgcatgacctgaagtccaccagcatcctgttcaggttaacatgtctcccatgtctatgctccctcaggtggcttccacaggcaaattagcttcatcaaacaacactaggtcttggcctgtctctacctcctgtctctaactgctcctgaggcaggacaggcaccccaaaccaggattaaaacaataagtttaacaaatgctataaaactaatctagtgtctgttccacaaccttcagagaaggtgttattttgccttctcttaccttttcatcagaccctgttctcaagtctctttctttcttttttttttccatcataagaaaacaaagccaaagagatggctgggagatgagggagagggatggcaaagacagctcctaggtctctggtttgcatggacctgaacagatagtggtgactttcaccacttggttttggtcctgttgactacagagggcctctgtgatatcccagaggaaacattagtcaggccattaatataggatcttcagctcaaacggagaactctggactggggatagaaaacggaggctcacgtacctgtgcataaatgctcactaaggtcaggggcttggataaactctcattatgagaaaacatgcagacagaagatcaggtctccagccaagaattaccaaactctcaatagttagtggctgagcgcagatgggcagatctgcaaaggaggcagaggagcagcccgagagacaagaagcaaagcagaagagtgctgtcctagaagtcaagggaagacggaacagcagaacgtctcatcagtgacctcctcttacccaccacgtcagatcccccaaagccttcattccttccaggacacatggtagatgcccctgcatgctggacacgaagtctaatagggcactctccagtacacccatgactttctgcttcattagctggcttgtaggctaaccaacagctggctaggtgtagtctcaaacctgtttatgccagttgcactggttataatgaataagcctaatcaaatattatatgaatacaaactaaaatagagtggtcccctcttctccacaggggatatgcctgaaaccacagatagtaaagaacccaattgctgccaatcagagcacatttctcttcgtgtcttccacctaaaaatttaatgcctttttcatcttcactaagcacatgtcatgcactgtggccataacttttgcagcctgaggtgtgacagcaaaactactagcgtgatttttttttccttcctcacaatttcatagatggaagattcattcttaccttagatcttagcaacttcagcatatgagttttcttctttctcacttaaaggaagctctttacagcttcattttggcatatccgaattgccagcatcactagctttgtgctttggggccactgttgagtaaaataagggtgacttgaacacaagcagttctatcccaagacagtggaactgatcactgagtggccactaagtgagtaatgggtgggtatattatggacagcatggatgcacaggacaaatagatgatccacgtcctgggcggaatagagcaggatggcacgagatttcaccatgctactcagaatagtgagtaattgaaaacttatgcattatttctagaatttttcatttcatattttggaaacacggttgactataggtaaccaaaaccacagaaaatgaaaccaaggataagggggaactactgtacaaacagtgaatgagagttattcataagaagccaaagattctaaagaaaactaaaaaaaaaataatagctgtcaaggtagatgaaggtaaggatataatagaaggcgaagggaaaagtaattttaaaatgtgcggggttacattcagatacctttgtaaacatctaaagtctccctccatcttcacaatgttgattgaaatgcttagctactgtatcatgggtttatgccaaaagatgacgcagagctagtcagcagaaacactgtcaaagaccacagctctgcacctaatgatgggcagatgaacgtttgttttcaatgaattcactgtgaaaacacaatcagttttgtgttttaagctaaaataaaatgtttacaatatataccttttaaaaaataattccctgttccaaccaacctttttgatttactgaccaattatggtctcaactgtgacagtgaaggagtggtcagtgttgccaggcccttcagtaagatgaggaatggaagacatccactggatttagagatcactgggagtggagaaatgcaaccaagtcaggccgaagacagtcaactgttatgtgacaatatcacaagccgttcttccctatcaagttcttttgcacttagtgtttcagaatttaaatgctgctttttaatctccttttttgagcaaatggtttcaatgtattttacagcagaaaaagcccttaaaaatgagaatgaggatgatgatgatgatgatagaagtattatggaaataatatgaacaacagtaacaatgatagctaccttccattggacatatattgtccaccagacattgttttatatgctttacaagcatccttgcttaattctcaatctctcagctatgtactattattatctccattttaaagatgagaaaactctggaccagagaagttgagtaaatttcccaagcctgcagagccactaagggttgaacctgacattcaaacccacgcattcagagcctatgctcttaacctctacactatgaattctccctaattaactaagctaatgttctcattctatagatcataaaatgatgtccagagggattaaacaattggctaaagagacatagcagtaccaggactatagaagacaccctcagatcccaatcctatgctttttctactataccacagtagtgcagcaagtgaatgtagcaagatcagaacaaaatgactcttaaaaaccaacaaacgacacctccttgcttctacacagttgtgtgcctccaagatgttccttgcttaaggacttgtttaagttccatcaatagtcagcttcttgggctcaggttttctttgaaaggttgattacagcgaagaaaaacaaagccttttaaaaatgtaatgtttatttcctcagtgaatttagtggtataattgtaattggaaaaaaataaagcatgaacgtatgtaacgtatttactgctatgggagtctacaatggaagaaccagaaaaataagaatagttacacagtggttacaaatatcaagcataaaccagacatgcttaatttcagggtatgatacaagaaaataaatgaagcaaatatttaaagcaaattcaactttccaattttaattttaaaagtgttattcaaagacatttataaagagagagtgatataattaaggcaagcaaaatgcaaataatgcaaataatgcaaaatgcaaataacatgttattgaccttctccatatcccaggacttccttcccacagtgcagaaatggaaggcagaagacaaaagtcaaagccaggggtgaacaggacatgatgccagacctctacaaggagtatgagctccaccagatctgagcttccctagatgacaaggctgccactgtaaccaggtctccttagtcaccttctgctctcctaatgagagtcatttccatagattttaatagtttctatcacaatgatgattttctaaaaacccactcttatatatctttacagggtcaaaatttaataggaattgccaaattgccccacattggtcttatcaattcacagtccatctatggagtgagaccatgccgtgctgacttctcagcaaagtggcagctggtgagcacacctgcatcaggatcatctaggggtgggaagagtgtgtttacattaggaatgcaggtcccaggctatccccagatctactaaatcagacctgcatttcaataaccagggccattgacttgtttgctcactcaagtctgaggacgattgtgtgagaggctgcctggagccacgtctggagaaagactgtgaagccaagggtgagctcactgggaaacagttcccaatcaattcataatgcctgcatggtggcaggaatgggggaattgggtagatggatacataagacacaaatctctcctttctcctctcctcctcattccctaactgcttagagaattcctactcatccttcacaactctttctagaagagacttcttcaacctatacaccaaggcctccctccttgtgtcaaggcaccatctagcactcaccatcacagttttctggcgtgtctcccagggaaggcagggactttgtcttgttcattttcttctcctcacaactagctttttgcctagtccataactagaattcaataaatccttagcaaatgactacgtgattgaaaaaacaaaaacaaaggatagagcaaatacagaaccagttactgggaaggacaagacagcaaaacccagcctcctcctctccaccatgctgtctcccatgaagatcccaggtcttccaagggtaaggaaaaacaggctgataaatgagggctggcggccagcaaccctcccactgcagccaggctttgtctccacgccataaacacctccttgctcacaagagttggaccctgttgggatcagcaaacagctgcagcaacagcagcatatgacctgcccagtttgtttaggtggcgtgtgtttgtgaggagcatttgctctgtggtgtttttctataacgattacgtggagaaatgatgttattttcagggggtgaggaataccaaagaggcttatttggcaaaagccacaatctgttcacttctactttgtgtgcgtatgtgaaaatcctcacgctagtagccaggatttttcaaatccactgggaagagactccaaaaacaggttgggggcaggaaaacaaaaccctaggatgacaagcatgcaaattaacactgaaaccaggcaaaggactagtcctgacagatgaaaacactcaagccagctgtatgtaaggattaggaaaattctaaataggggagcattctgcccacaagttttgttaggagaggacattaacaccagtcatttatggtcctcaaagcccagtatattggtgttgggggtggaggtgtctgctgtgttcaaaggacagtggcactgaaaactcaggactcagagacactctcttcttaactcctcaagctctcagataaccaactagtagagtcaaaataatctaatcatggactattaatgcacatggcaaaaactcaacggatatcctagtcaacataattctacatcggctgttctgtcaagatgataatgaaacatcagacaatctgtgagaacatgatgccaagaagaaatacaaattgggctcctccattcctcatggaaattagaagattctaaactaatcaattagtttcacatcccccgacacctccctcccaccgcccccacccccgtctctgcattatcattccacttcatgaaatttcctgggaatccacttactattctgtgatcaaggacagcaaatgaaaatcaagttctctgcagaacatgagcgaaactttacattgtaatgtaaaatgagctgattaagggcacttaatccaagaacagctaattcttaagacctcgaagcagagtggatgaaatgtcaggaaggaggaatgcagccgggttctaatcacacagaaaaatggattccggcactcgacaggctgccttattaacaattacagtaaccagggctgttcttttcaaaagaatgcctagcaagttagaataaagaccccatcttcggagatctgtggtagaaagtatacccctctttttagaaaataaggtactccagcctctgggagcatcctaaaagatgagaggaaactcaaggagaatggtttatctttctgaatggtttatctttctaatttcatctcattcaacttcttacacattggaaggtgattgtaaactcaggtatgttaggaataagtttattattaaaaagtaataaacaccctccgctgaccaaactcttagaaaaggattacagaaccacttttcactttgaaaaattcttgaggacccccctaagaacttttgtttatgtgggttacatctatctatattcttcacgttagaacatttaaaactaagacattttaaaaataagaatatccaagcacatattaattagtgatgataccatcatgggtcgtgtagccacaggaaaactccattgcacgcttgtcaaagaataagagtggaaaaggcgaacaaaggtcttagtatcattttgaaaatagttgggaccttaagaactcccaggggtccccagaccactctgagaaccactgacctagagtcatgtctggttgacatagaaatgtgttagagttatagagaggtcaactctttcaagaaccacttctgtcataaaaacaaacactctgtgtattatgtgtcaataaaaagttttttttttaaatgacagatgccattgctataagaactttaataagtatatgtgaaactttctggtagctggcaggaaaacaggctctttaatcttttacagttcaccacatttgttttacagcctctgcaagtacagatgactaactgcttctacgcagagctgtgcagcgtttctaccaaaggccaggcctgtctgggtaaatccattcccttcagtaaacattgcagggaggcaagtcttcttaagaagcagtttaactcagtggttaagagcccaggctctggatttagacttcctgggttcaaatcctggcttggcctcttgccaagtgaccttgcatgagttcttaatcttcctccaagtataaaaaggaagaataacaatatttaactggtaggatcttcataggaatcctatgaagggttacatttctagaacatagtagtactcaataaatgccggttatcattataccttcttttacgatatacaaggcatcccaaaagtctcaatacagttttatgctgaaatttcagaaatataagcattacaaacttacctcaaataccacttatttagttctgtaaattttaagtaataaaattttagttttttgtttcggtgcctctgattgaaagtggcaagtgctgcctgaaacaaaaattacattactaatttcacagtggagcagggaataagtatacacacaactattagacaaaggagactttttaccattaagacttaattcgatagacatggctgtggtctgaatgtgtctcccccaaatttatgtgttggaaacttaatcctcaacgcagcagtgaagggaggtgagtccttttgagaggtgcttaggtcatgagggctcagcccttatgagtggattaatatcattataaaagggtttcacagacagagtttggtcctttttgccttctgccttccaccatgtgaggacacagcattccacccctctggaggatgcaaaaacaagtcactatcttggaagtggagatcagccctcaccagacaccaaacctgccagcaagttgatcttggacttcccagcctccagaactgtgagcaaaaaaaaatctttgttctttataaactacccagtcttgggtatttcgtttcaacaacacaaaatagactaagacagacattctttgagcacctactatgtgccatgcttgtgttaggtaccaggaagataaaaggaaacaagatgagatgattagacaatagaggtgtacaaagccagcaggggcaagcatggaaatagattgctgcagcatgttctgctgtattattcaggtccaggtatgctcggggtgctggagtttcaggtagtggggtgctatgcccaggatacagcagaaaggaaaaggaaaagtgtttctctcactgacatttggaagacattttccctcctcatgatgtgaatttttcctttcacttgtcattaattctgttcatctgcaagaagcccatctatctatagctttccttttgcagtagcttttcaatagtggatctttattgagcttttccatctttgtaaatcgtaaattgtcctttcaacatgcataatgacaagcatttcgacccacacactctatttacatatcatagcaaacagcctcttatttagatgtcaaattccagcaactaaaaactcagatccacaaaacagcaagaagccaaataattctcaaaaccataatgctttccataaacttcagttccctttgggcagtccttcaggccatatagctgttctttttaaatacacatttataatgaatctgtccatctgtttttctagcagattagaagtacaaaaatcaggggagtcatctgaaaacatggtgcttagcttcacgaattccctaaaagttacaacccagggctactgggttttcctttcttttcttttccttgagacagcgtctcactctgtcaccaggttggagagcagtgatgccatcacaggtcactgcagcctcgacctcccagactcaggtgattctcccacctcagcctcccgagtagctgggaccacaggtgtgcaccatgcccagctaattttttgtattttttgtagagatgaggtttcgctgttgctcaggctagtcttgaacccctgggctcaagcaatccactcgccttagcctcccaaagtgctggaattacaggtatgagccactgtgcctggccactactgtgttttctgaaggaaattagttttaacagaaccagaaaggactaagtaatatccacaatgtgtaacagacacctaaactcttacatgaagagttatgtgccctagtagaaaactatttttcattttctcatatctcaaaagattgaaaattacaaatcctagcactttgggaggctgaagcgggagtctctactttaaaaatttaaaaatgagccaggaatagcagcgtgtgcctttatcccagctacttggagactaaggtggggcactgcttaagctcaggagttcaaggctacagtgagctgtgatcgtgccactgcactcagcctgggtgacagagtgagaccctgtgtttctaaaataataataataataagtaaataaatgaaaattacaaataaaactcaactctacattcaaaattttcttaaaatttttcttaaaaattctagtccatgtgcagaattcacttgcttaaataagccatcacttatatctagtcaatatcatcatgttatagaaaaaagttgaaaaaggaacatattatagaattattggccattgttgtttatttaaatgctagaaaaaaaataagatttatatacaataagttttgagagaagtttatcattttttggttcctataacttttagttatttgacatttgcaaactaaactggaaaactaagaaaattaaatgtgatttttttcttctcagataactgaagccaagacatttttgagaacatgaattttccatatgattgacttatttcaatgctttgagtgggcatagctttattctaaatttttatgaattttagagttgattcagaaattacaatgtgaatattatataaaatcagataataatgtagtatgtaaaatatgcatggtggaaggagtaaactgtgtagattattctggccctgcaaaacacagaagtgtctcaatttctctttttccaccgtgatttttatctattgtgttattttgatatttgtacatttactgggatctggcaggatgagttgcacatgggtagcatttatattaactaaatttggttttcattttagaaacaaattcctcctttcttctttttttctgctgccaaagcccaataggcttataaataaatacacagcccacaggaaagacttgaggaggttcaggtagacatttcatttgaatttccggagcctggttttatcttaacagccctcatactccttggaccacacctgggcaagcaaagtgaagtgggaaataaaatagttggatcaatgacgtcaacaaccaacgccgctgtccaaaaccaaaacctcacatttcaagcagaggctgggtggggaatatatatttttttaacctaaatcttcttctcattttctccttttttggtgagggtagaaatatcatgtaagaggcctgttatacagataactaacgcaagagacacgtgagcagacgtcacttgagcctcattttccatgccaaaattcaggatttaaggtctaaaaccatagagaatattttagagctagatggttccagaaaatctgagacatgtggccaccacagctgtgaagtggcccactctctcccacctacccaccccagaatttcttacccttcataaggcagcccctactcgaggctggccagacttcttcaacaaatgacagacaaagcaggtttggtcccaatgtaaaatgaagtctcagaacccacggctcagccattttggagagtgagatgaggaggccacgccacagaggccctcgggcagcacagctgccatgacaatatgggccagtgccaggaataggaaggatcaagttaaatgtttgtgatccaataacaaaaccacaacatgggccccattaagcaaggtttaggtagaagctaatgaactgaatctaattttcttttgaccatctttgacaaggaataagctctgctataatgagtttcttaggcaattcaaatatagacattacagtggggctcaataaaaaaaaacaactctcacaaaggagctgatctcctcaaatagactctaaggtggtttaactgggaagcatatatatatttctttaaaactcttccgtgaataatcaggaataattatccattttaaaatactttttatatttccatttttaattaaaaatatatacacatacacgtacataaatacatacacataaatgtatgaattttccaccaggaaacccacactaaatacctagggtttttctgtactaattgaacacactatcacactataacccaaaggcctggccacagacaatagcagatgcttcaagagaaagaatagggccctttcagccaattatacaattacacgatatgaccatgtttacattatcaaagggaggcagaccaaattacctagctacttcaaattaataaccccatttacctcaattatctggcaggcagggtctaaataacctgagtaattacttcaattcattcagatggtatagatttggcctgtgtgtccacaagtaatttttccttccagtacacacaccttaaaccatcagcaaatatcaaaatgcacaacagcaaactcctgtcagtttcatctataagcagtgtaagcaaatcctctccattatctggcagattaaaatttgttatactcttaataatccaggttgaggttttcttttctgacaaaaactcactggaccatagaattttagagctaggaagtaccatccagggcccacagtctaaaagccagctcctggaagcagtccaaccagaaattcagcctgctcactcatagcacgtaaggcaaggaggtctgaagcccaaatgcgtgggttcaaatcctggctctgccacttactagctgaatggccttggcaagttcctaaaccttgccaagcctgagtcctcttctgtacaatggtggtaataagggaacctgatttatagagtcagaacaaggattaaatgagacaatccacataatgcacttagcatgcttcttggcacataactactattgttaagcccgtactattattattcttatagcagcaccacctttaataggttcccccaaaggatgtgtccatgtcctaatccctagaacctgtgaatagtaaccttatataacaaaggatgtgattaagttaaggaccttggaaagaggtgtttatcctgttttatacaagtggtccctaaatgcagtcacatgggtccttataacagacaggcacagagagttttgaggcagacacacaggagaggacataggtacatggagaagaaggcaatatgaagacagagcagagagctgcagctacgagccaatgaatgcagacagctgccagatgctggaagaagcaaggaatagattttccttcaagaaggggtacgactctgttgacacattgatttcagacttctggcctccagagctccaagagactacgtatctattgctttaaaccaccacatgtgtggtaatttgtcatagacagcagccccaggaaactaatacactacctcaatgggtgcaggtctcgtttgacctttaaactacaacttgcagatgttaacagtgacaatgataaagccaaagataaaggtgcctaaaaaacggaaacaccaagggctggtgttatgaattgagcttaacaaaagtaaagaagcggaagaatgcaagagacaatgagcaaagaggtttggttgaaggatacacaagggttcggggaaggaaacacaggaagcatgaggctagagcctgatcctgtaatggttctcacccactagagacagaaatctacaatgccagtgtgttgtttgtttctaaataacatgtttatccagtcagtactctatgctttttctttttatttattatgcttggagtttgtacaacttcttgaatctatgggttgatctctcttacaaatctggggaaattcttagcctcaaacactgcttctgtctcattccctccctcaaacactgcttctgtctcattccctccctctctgctccttctgagactccagttatacatatcttagacttttcactgtgccccacttgtctcttatgcttttttctatatgttccatttttccctctttgcatttcagcttaaatcgtttctattaacctttcttccagatcactattcttgtcttctgctacatatgatctctctgttaaaaccctatccattgagttcttaattgcagatatctttttcaagtaatagaaatcccattttattctttatagattccaattctttgtttaaatttttcatattttcatctattttatccattaaaaatttattttcttgaacatattaattagttatttttaaattccttttttgctaaatataattctattcactctggatcatctgtgaatctgtttctatcatttgtttttctctcatttttggggaatggtcacattgacacacctaataatttttgattgaataccagacatcatgtattagaaagttgaaaagatttctgatgaagttatcttcctcaagagatggctctcctttcttctgtcaggaaaatagagttggggatgggggtgcgggctgatgacctaaaccaatcaggaactattacaagactcaggttgctcctggcttacaccctttgctaggacttagccctcctggacttcactgagagcctggtgtgttcaccatgcccccacccctcccaacctccaaaagcaggtactgaactgtaaatccttattgtctcagcaccagaagattactcaacaccccttctgctttccggagggattctgcttatctttcgaacctctcgtcccatgcagtccagaatttagcaactgtcttgaagggaaagccaactgtgcatttctggctcctcaagctccaattttgtctctccactccagtcccaagagaacacaaacgctctgcaggtttatttttcccagagcagcaacattccgtccaagcaaagcccaggtccccattattttgtcagcactcagaattagaaatctcccaaaaataaagtagctacagatcgtcagctcacctctccacagttctcttcttcttgatattttagccccctactcctcattgtttcaacacttcccagatttaaacagaatgttgctttctgtattttatatagtttttgttgttcttcttgggatcattagtttgcctcaaactacccaatcctagccagaaacagaaatttctcctttatatttttcaaagtgttttcattgtcataattagttcccccccatataaactaataataagaagaaggcagtattttttactctgatattttagagcacagtttgccagtgttgggcaaactatggcccacaggccaagtccagcccactgcctggttttgtaaataaagttttattggaatacagccatgtgcatattccaataaaatgtgcatattgtctatggctgctttggcactacaaaagctgttgcagatttaagtagttgtaacagagaccacatcacccacaaagcccaaaatatttaccatctttccctttacagaaagtttgccagcccctgcttcatttgaaggaaactgaagctcagacacattcagtgactcgcaagttaactttggagagaagattgcatgtgcggttccctgattcttattccagccatctccccactcttctaatttgcttcccatcacaatgatttattacaatcattttttaagattaacacaacaaggagagagacagaggggaatgagtctgaagcagacagtcccagtaaggaaaagggaggtgtctcagcgaacacaattaagggtctttctatttttggaatatttggggaattttggcagtcaccttggaaatctgctaaaacaaataatggaaggcaactattcaaggatgccacttcaaggtaaaaaaaaaaaaagccttagtatttcatagaggtttttgttgttgttgttcagaaaatgaacatataaggaagaaaaatgagaagtatcctgaagaatgtgttcaatttttatccatttgattgctgaacgctttcatcaaggcaattctctgagcacaggaaaaaaatatccccaacagaggttggcagctcagagggacacacacacacacacacacacacacacacacacaccccatgcctgattaaacaaaataatttttaaaaatccaaaatccaatacagttcgaaacttaacaataatttaaaagaaaggccacttgctttcccctcttctgctttatacaaatacatggtaatttgcttctttttaatagtttgtacaatctgatgagtggtgcaatttagcccccatgtcaattacggatgctaaaaatttcagaattataagatcaccaaaattatcacacccaccaaaaagacctgctggggacagctaatctttttcttttcactataccttgtgcagaaggctgagcaggggatgtccacatcttgccaaccctggagctccattttcccagggaggacttgagcgggaaaagcaagatgtaaggtagagaaagactaattcataaaagtaagggagtcatgcccttaaaaaagaaacacaaactcctctaaaagttgagaaacaaaaagctctcgggcctccctgacaagattccatagttgtttctctcagcgcttagatttctccagaggcagaaaggcagaagcagaacttagctcacatttctttgaatgagccatttaaatgcccatcactccacatcactctcatgctctgaattcttctgtggctccccagtgctcaattttggggtccaagcgcttgaatgcaggatacaccatgcaccacaatcttgcatctctcatcacattccgttttcagccactgtctgcctagcacgtcctgctcttgcaacaaagaacacttttaacttgcatcgtcctctcatcccagcttgcaaaggaacaggtacacatgaggactgcattcctattcagggatttacgtgggaaaaaaagaaatcagtgttttactttacttttaaagatgtaatatctatgaaatctctgttgttatttacctatgatagtaaaaatattgcaaaaattaccaaattacgaagtatgaagtgacctccaacatcatatactccaaattcctcaactggtggttcatgaagctcagaaaaagatgcagaggattccttctgttctttgatgaacacttaaggccgtttcagagaagcagccattacacccctttccttctgggcctgaactcaggctccttcctaatttaaggaaaaagtaaaacaccaaccatcctcagaaaccaaccttctttacaggcagaagtttcttccaacctgttacctgcgaatttcaaaatcatacctcctgtctgccaaacaagactgccagcttctcaaagcaagaactatactgaggtaggtatagacactcatgtacacagagacacacacactgagacacacatacacagacacacatacgcttctcatagctgaaaacatggaaggcagtccatctttctagacagtgagtatctaatacaagtcaagacacagtaattacgctacagacaaagggagggaggataaaaaggaaggtcactctgattgaagaggagatggttagtagggggatggatgcaaaggccagatgtgggagaaagagactggcaggcctaaggtcaattcttatcttgtcagtgtggagaaaaatgtgttaccagcagcgtttagtctaatgatgtgtgagagatacacaaaacaaaaaggggggtgagggttttgggtagaaggaaatcatgatcgtagtccactcctgagctaaaggcctgagcctgggaaccagtgggaggaatgaaacagacggatgcatagagagatgctggaaagaataatcaagtggatatgatggcattggaaatgagggaaggcaggagaataaaccacagtgccttggtctttcaattttgaggaagaaagatcccaaggtcaataacacctcacttatgcagaggccccttggctcacaaactcagccatccagatgcagccccctccttctcagactgctccagtgccatccacaacattccacacaggccctacacacaggacatggccccggctgcctccgctgcccgccactcatcctcatctctactggatccagacacttgactcattcgtgatcctcaaacatgccaagcacatgctgaccccggaaggagccttctgtaagagagtgggcagggcctgagcccggggaatgcccagggttaaggggaagcagagaaaagccctcaaagaggagtggccaaaagaggtgatgaccgtgcgccatggaagggaaaccagagatgcaaaaagccaacggcagttcatgcacatcaaaagcttcaggggcatgcaagtgaatggaaacaaagttcagttgaagaaaggaataaagaaaggaaggaaagaagacagaaatgggtgaaagcctttcacagcaaatatctctggcagacagagcagggagcagaccccagaggaaggaagtctaaaagagcttcatccctcaccccactcgtgcattttggcagcacccacctaagagtacactttggggaaagagggtgagagaagcaggctcgctcttactactacccccaaattaattcctcagcaagcctttcccattcattatcatcatcttttcttcataaatcaagtctgccagactcaaagactggaacattcaggaagtgcttactcaaaacatagaaacatcaatatggagactgcagaccccagaatgataacagggtgagctatatttatatcccacggctggtgatgcctcagcacacttcactctctagaaattccgtcggcttaatttatgtggctcattcctcattccctttcagctgacaggcttcttatctttttcatttggaaacttatctgtaggagttcccaaaccctcactgtcgttcgtttttgaagtacctgcattctgtctcgagtttccggtagataagtagggctcccttagatgctgtctgcctataccccatgactgtcaaaaatgtccccaccctgggatcaggcatcagatcctaacaacactgacagagtgaagggcacgtttctccctttggtgggattttctcttccaagccattaaaacactttaagatgccttttcatatctttgctatctttagattagatgcttaatgcataaatcagcccaaatagagtgatggagtagcggggagaggctgacgcatttcctcacgtacaacccagcgtttgagtaaaaaaaaaaaaaaaaaaaactttactcagaaaaaagataaggctaaaatcagatctcagattaaaaatggtaaggaaattgcaactagctgtagccaattcaagctgagccaattatcaccaatcataaaagatgacttataagaggccctggtgccccagtacaatggagcaattaaatctttataactgagacaaaaaaaatgccacataattagacacagccagaaaagggtacgtatgcttccccttcctgtggctggcccattagggcaggcatgcagccatttcttcactgccaaaaggccaatccattccccccatcactcagcctgcctgaatcgcatctgacactggccactaaggtggagtttcctttggccacaggccactaacaatccttgagttcccgcctatcccacgtccaaataagtacaagaataacagtgtccttatcccacaggttacatgtgaaaaatatctagctgtctattgaagaagtcaagggcatagcttccggagctaggcactaaggttcaaatcctagctgcgcaactccctagcagttttctcatctgtaaaatgtgcataatcatagtatatacttcactgagtgttgtggggattaaaagaattaatatatgtgaaggacttcgaagcgtgactggtatatattaggtgctatgtgagtcggttgttgttattacatacttcccaatagtatcattatcatcatcatcattattattaagcactttacaatagcaagagttgccatcagcagccagttatgaggctgttatgcttatccaggctggacaaatctgggccactggttagaggaatggagaagacaagctgacaccaagagacagtgcaaaggcaggtgcacgaccttccacagatgcctggtgcaggcgggaaggaactggagacgcaaagtgggactccaggatgccgcactggggagcatggtagggcgtgctccacagagggaaggggggaagagagaggaccaggagcttgggggcagacatgctggcctgaggcccctccaggacttccacagaggacggccttgggcccagaggatgcttgctcaccttgaacatgaagctacttctttttccctccttgcacaacagcactgactggacacaaagccaaagtcaaccccaggggaagataggacaaacaatcacagcaagtacatccccaaggaccctttctgttgacacagggacatttcctgaaggtttattctgccccagccgctccagatatgttatctcatttcaccctgacaataacccagaggagctgtgtgctcagaaagggttaagtgacttgctcaaggtcatggggttagcaaggagcagaagtgaaaattgaacctagatctgtcagaaagagaggggggtccaggctacagacccagaaacttgtgttctgacaccagagatgggatttctctgggccttcatttgtctatctttaaaatggggatatttgtccttcctgctccacttctggtatgactgaggatgctcctatagatcaagtctcctgcagataacaactataaactctgcacacacgcacacacacacacacacacatacagacataaaaacaaaacaaaacaaaacaaagcaactttctgagggcactggagaggaagccaaggcaggcagatactggagggcatcaacacttgcaagaaaagtactgcactgggcgaggttttgtctctgatggcttttagcccaagggcaggccctggttggtaccacaggagcagctaaaactcggacagaaacccacagtttactggcttgaagaaacagaagacagaacacagggctacttcagctggtagaatatgaagagaaaaccccagaaaggagagagccagagaaaagagccccagattctgtgtataaactctgcccagatctctggcagactcctgaaccatgcatgcacgaggtactccctaagcaacccagctaaggctaaaagaacaaatttcagctgccacccaagagacagagttggcagctggagtccaactgcttgtttgctaaagcaaacaaacaaaatcaacagtcatcagaagaatataacagaatccagagtctccacaccatcacagtcacaatgtccaggatacaattcaaaattaccacaaaaatgtcataaaaaatgttacccattttaaagaaaaatggcaatcaatgaagaccaatcccaagttacacagggtgctagaattaacaaacaagaatttccagataactattataactaaattcaatatctgtccaacctacctcacagagttgttaaaggtaaaatatgcaagcaaaaagtgctttggaaagtttcacatacactacctctaaaaaataaaaatagaagtggtctccactttttatatctgttcccaaaaaccacagaataaagcaaaccattttaatatgcatctttcttctaggaataagttacactcaaggattgatcaaaaccctattgttaaataaatcacaaagacaaaaatgtgtgactataaatcaaggcctataatgcctattacgccacaaatcattttaaaacgcaaaatgggccacatgtcacagtctactttatgcagtgggaggagacagtatgcatagtggttaccatcattggttctgaagttagacaacctgggctcaaatcttagcctcatgacagagaagctttcttccaaggtgagttacttagcctctctggacatcagtttcctattggaaaatatcaatattaatggtccctgcctctcaggattgttgccataattcacatacaggcctgcatagcaacttggtgcacagtcgagtgcttaataaatagcagccactgtaaaggaggtcagggagagaaggaaacttgcccagcattgtccagctggccaattacagaacagggagtagaacctggatctatttttccatttttaaaactcttcttcacacaagtttttaaatagacacacatgcactataaattggttatcccaagttccttaagcattctaaaacacacacataaaaacacaaattatagctctgtcatggcacaagtttgatcaaaaaattatgaattttagaaatcagaatattttatttttaaactattttttattcctttgaatttgaaaagtcttaagatgtggtttagaaggacactctcctttttaaaaggtgaccctgaaaattttacatgagtgtttttctatttccaatcactttcaccagcgcccacaccaagcctcagaattcactcacacataatcctcgatagcatcttcatatgggggggtctcgctgcagcctttgtaagcagagaccaagcacctcctgaatatggttctttgcattcaccatttttcttttctcttccttcccatttccctaacagctgacacagcattaaagaagttaagctgttaaaaaaaaaaaaggcttgaggagttaaagaggaaaagtcacatttctttgcctgaataatgtgaggattgttatacctgtttgtgaaacttgggactttgtctttaaaaaaaaaaacaaacaaacaggtgttgggatggaaagccactgagaaaggcaaagtgttcttctctgcatagccctcttgctccctgtgaccgagtgaagggcttgagaaataaactacaagtattaaacactaactgcaaagaagaaacagagatcatccaaataggcagatccaaacctaagccaagagcctctagcccagttctcgttttgtgagaagaaattagaaccttaaaaagttttcagaataagaccccaaacaaccaagccaggaagaggacagaaaacctggaggagcccaaaggggtgcaggaacttctgacaggtgtatggtgggaggactggaccaggaggcattgatgagaactcagccagaacattctagaattacaaggaacaaccggcctgattaatatgcggaatcttggcaaggcagaaacgattctcagttatgtttcccactccaggagaacgtgacttcctgttcgaaatggaggagggctttgtcccaacacatgatgatcttcacaggctgacattctggtctcttcattacacaggagtgacgcctgaagctgaagcaattaacacaatgttacacgaccgaaagctgaggcaaggggccagtgtggagccatggtgagtcaccaagaactctggattcttccaggggctggcactaccaggttgactggccctgggagatttctttctccaacaatggcctcagtttcctcatctgcacagagtcagacaggtagggcgaccccaaaagttcatctcccttctaaatgatactaggaaatctgttggctataaatgaactcatcgataacactcatttcccatttagattttctgaggaagtgactttggacaaccatggtgtacacacacgtacacacatacacaaacagtactttcagtctgcaattgcctgtctattccttcagcacaattaggtcaacactgttgaccacagtataccacctccaccccaatactgggccagactccatgataccaggtgactgggtgtgctgtggggtgccaaatgtccacatattgatcatcttatcacacctattgaaaaatccagtaagacttgaagtaccttcctgtcagatgattaaataaggtccacaaaaatactctgttttctttcttttttctttttttttttttcctgagatagagtctggctctgtcgccaaggctggagtgcagtggtgtgatctcggctcactgcaatctctgcctcctgggttcaagcaattctcctgcctcagcctcccaaggagctgggactacaggcatgcaccgccctgcctggctaatttttttgtatttttttttagtagaaacggagtttcaccgtgttgcccaggctggtctggaactcctgagctcaggcaatccacccgccttggcctcccaaagtgctaagattacagttgtgagccactgcacctggccaaatactcggtattcttgaaagcattctattagtacaaggcatttttactttcttccaccctgctggctactccctcagagacggagagtccctcaaagtcctcccacttctccctatccttccctgtcctagaagcacgaaacctacctctccgggctgccctcgcccttgtgaacactgacttctctgaccaatgcctgtggtcctggtgacctgggctgtgccacattccacactgttctatcgtgcagttgcccacccaatatggtgaacaacagcccttggagagggattgattaggacaaacgccctcattttgcagatgaaggaatgaaggttcaaaggaattctttacatcattcctgtcttggggaggaaatcttgcacttacatttgactcttctttgcatttggtataaaaatagctatcatttactgagaattatctaggggtctaaccaatgccttttctgatgactttattcaattctaacaacgccaggaaatatactgcattttacagataagaaactcagactcacagggcctaagtaactcatccgaggtcacagagcaaatgagagagatgggtctcccagcaaatctgcaggcctcagcccagagctgtgccacactacagcccatgcttttaatcactctgccagcactattccctgacatgcagggtgatggactgctacacagctgctgattaattagtgaatgctgctgctatttgccctcctcccccaagataaacaaaggctgaccatgagaaagataccagtacacccccaggaagccagccgattctctggtgatgagtgatgctgggaacagcagactggacatctatgggcatctgatggccactttaaagcactcaaggagaggtgaagaaaaaaaaaataggctcccctccaatgcaatttttaaaccactgattcaccatgcaatgcagtgttaaagtcaaaagaaccttagccactactgtatttgcaaaaattctgtactttgttttaaaaagcaccatttgttagcccaacattccccatggagccagttgggagatgacatcttgacaagttggactctttcgggacaaagaatacaagctgcatcagttctatttcttccccagccagaatacacaggactagccatcaaggggtagaagcaaaaatggctcctctcctcttaaacctagtgatatggtttggatatttgtcccctccaaatctcatattgatatttgatctcccacgttggaggtggggcctagtgggaggtgtttgggtcataggggcggatccctcacgaaaggcttgctgtcctccttcgaggtaatgagtgagttcacgtgagaactggttgtttaaaagagcatggcacctcctcgtctcttgcttcctctctcaccatgtgacacaccagctccccttccacttgcacaatgtttggaagctcctggaagccctcaccagaagcagatgctgacgccatgcttcttgtacagctggtggaatcataatccaaataaactttttttctttataaattgcccagtttcaagtattcttttatggcaatacaaacagaccaagacacctagtatgtttagagttttgcttaccagccccacaatttttgaatctgcagatttggagctgctggttcccaagagaggaatgcttcctccaggagacactgcaatggttttactgaactagaagttgagattgccccttggctattttagactaccaatgccacagaaacaaaaggcaaagaaggcaattaccctactgggtgaggtgaatgatcccaatttccacagggaaactggactggtgccattgctgccatacaacaggggcagagaagagtatgcctggcacctggagagtctctagagtgcctcttggtacttccatgtccaagagtaaaaatcaatggaaaactaaagcaactaacagacacacagagagaatcactgaggattgagatccctaggttattccaccgggtaataaataaacctctgccacagaaggtgctggctgagggcaaaagccaagtcccagcagtcacggtttccatattgaagcaatgttaattcctcctctcattccaccaatcccagataaatattctatatcctacagactgaaccaggaaaataatttatgccacccagagacagacaccatgccaactgggactttttgtcttcccttaagagtgtgaatactgcatgaagcatagacacatcataggcagaaacaaagctgtcctgctgttgtgccaagttgaaaatgtgcaggaggatatgtgaatgctgagaatctgaagggttggactgtgctggtcatttagttgccatctttctgatccaagtctgacctgtgtggtggggcgaggactgtgcaaactgcatcctcgctttgccagttgaatttctattgggttctgccagtaggggctcaagatggagaaggcagaggggaaccttaaagtcaatatacctttacagaaagctggtgtgcatgtgcaagagttttaaattattctgaattattgcattttcatattaatcattcactcattcagtcattcaacaagcatcctcagcactgaggccctaaggatttagctgcttagagaacaaggacaaaccatgccctcatggagcttaccattatggttggaggacatggtaaataccacataaacaataatatgatttcagatgatcgtaagttccacaaagaaaataagatagaaacagaggttgacagtgagttgggcaaggaaagaggctgtttggggcaaggtggtaaaagaaggcctctctgaaaagctagcatttaggcagagactataaggatgggagggaagagtgaatgaactgggagaagacctgggacccaaggcttctaggcagaggggctccattaccccatcagagagaaacaccctgggtcatgtgctataagaggtatttggagcaatgccacagtcgaaggagactcaccatcgtgggggaaactgtttgtttactttcagcaaatcctacaaatcagatatagcttagtggttgagttcatgtcctcactctggcatgtggttatttttctttactttcaatttacattgcaagcctggagagaaatgaattacatccccctgggtttctctgttccgtacaattaagaaaagctatttcttagtcataaggcggatgacgacaccaagatttcccattttctctccacagggaggctgtcatcactcaatattaattgatcctacttttcatccataaagcaggggctgaaacaaatttttggtcacaaaaatggcaactattacactattaaggtaaattattaatggtgcctccattaaagcacactcctgctcacatggcatcagctacctcaatgcatggttgtttctttaatggggaaaaaggagtaaattatttggtttttttcctgaaactggattaatcacctgcacctatctcatttaaggttgctggggattttccacagtttcatcacaactgagaacacacagatagggctgtaatatgtcttgaattcccagcaggaaagtgtgtcaattgaatgcaattttatttttctgctagagagcagataaagtgaaaacagcaagaagacacaagaaactttcacaagttgaggagagctagtatcatttaaaaaaatgtttccctagacaaataatttgatgcttatttttagagaggctgtggtggtgctgaattagggaaacctagtttaaaaaaagaaaagaaaaaggagaaaaacaaccaagttgtatctacaaataaacaacctgcaatgaatcagggacatatgggaagagccaaacctcattaccactgacggcagcgaccagatgctggcacccaggaaaaaacaattttcctattcaagggagggctctgctgcccacacttccaattccttctcatttatttacatgagtgctagggccttgtggaaggctaaccacaggacatttgcatctcatcaatatgtttaaatgtcacaaatcttgactttcacagctgaaagccaggcttagccacttacaaccaggctgatgaataactggttgacgcagaaggcatttcttaaacatataatttaatctgagaagtgatgagctctgctcaacaggcccatggcatgaaattagaaaaacatgctaagcatgtgtctccacagtatcaaagaaatgacaaaaatggaaaaatcaacacagtgatcatttgcttctagattagcagaagaacatcgtagggaccactcttgttgatggtctttaaaggaccatcgctcccatctcccaggtgctgtgtggtggctgctaagcactcacagctgccccttcctctggaaaattgtccccaaccaaacaggagcttcctgggggagtttaagtgacttgagagtgtcacaaaaactattaatgtgacccctttgttatactcactgtgacacagactgtgggctgtgtcaattaaaacccatttccacctctttctagctaatcttcctgaaatatagagcccgggggccaaaagctacatttcccatctcccaataaggaaactgaggcacagagaagtgaagtgactttctcaagctcacacagctaataagcagcagagccagaatttgaaaccaggttggttcaagagtctgtgctcccaacaactccatgatgttgtctctcatatagaagcaagactttttaacataaactgcctgcattattaatatataacaaattaccacaaaacagtggcttaaaacaacatttattttctcacagtttctgtgagtcaggaatccaggtgcagcttatctgggtgcctctggctcaaaatctttcatgaggttgcctgaggacattggccagggctgaagtcatctcaaggctccactgggggaagatccacttccaagctcatgcacacagttgttgagcaagattcagattcactttccccagggctattgggcttagggccccaattcctcactgcctgttcacaggaagcctccctcagttccttgccacatgggtctctccacaggtcagctcacaacacggcaaccagtttccttcaggggagtaatcaagagagagcgggagagtgcaagatggaagctacaatctttttgtaacctaatctcggaagtgataacccatcacttttgctgtatcctgttcactagaagcaattcactaggtacacaaggccgtggataccagtaggcaggggtcactgggggccatcttggcagatgtccaccatgctacttgatatcataacactaatgagcaggaaagttgagttaaagttgctttttcattaggtaacttggctcccaaacccaagcactgtatagtactctaacattccttgcaggtaggagaacaaaaccttggctggttcacccctcagggacactgatccccatcacttgccttaagccacttctgaattcacactttatatccaagaaagtaaatggtattaagaaaaaagatattttcttggtttttagttgttttaggctaattcattaaatgaagtccacaataagaaactacttatagacatgagagtaagtttttgttttcatttacagtctctagattggcaagaaacagtggtaagaaaagaaacagttggatcaccagtctgagggatatggaaggcaatccagaaaaacctcaacatccttctccccattccttgcacacctttacagcattattccagcctgggctattagaaacagcatcagtaacttttctttcacacacttcatctcgaccatttctcaccaagcaagccatgatggactgaagaccggtgagcccatgctcagggcatctttgatgcatctattaaggccttaaaagttcagcctgttggcatcagcagccctgatgagtccactcacccccaggaagctcgtttgattgaggtaccttttccaagctgcagtttggttggtgggtccaaagattagatttggtttaggatttccagggccccctgcacctaccaaacagcagacaagtctctagccatgcaaggtgcagcaggccaaaggcaaataatggtaaatcatggcagatgcttctccaagataacacacagactctattagggctatacccaagctggcctggtttccagatataggagaacagacaccagactaggacattaaaaactccagaatttggtgggatgtttcagacgctgtttcctacattgagagaccttactatcttgttcaccattgcatgctcaatacagagcctgaaaaagagtagataatcaataaatattgaatggatcaattttgttaagtaactttgccagacaagactgctttctccaaaaagaaaagtccacccacaagcttgccagctcccttgggaatatattattatacctatcttgtgtcaaagcaacatgcattccttatagtgccatgttgtactcatgcttacaaactaattctgagcttacactagggatgcccaagtgaaataatcccttccctcttttaagagggcccaatgaggctgtcaaactaatgtgtactcctcctgataaatcatgtgtatgtacctgcaaagtatgtttatgcaacagaatagaaaaacatctcagtggctgctaagtgtagcaggtactccttgcccatgtaatttttacttatcaggagccctgacctgtaaacaaagaagagtatgcctgaaacacagaactgaggaaatgaccttctagacttaatgacagtggcatgcaacttgaggccagaatcacctaccttttcacaccagatttgcttttgaaaatatttcgtagataaaattcaacaggactcctgtcttctgaagcattggtgaaatatggtcaaactataaaatgacagtggacccagtgaaattagagaaagcttaaaattctttaacgcaatattgctaataataattagtagggtgcatagaatattaacttgttttctgttccgctttaaccaaattagataacaattattaccactacctcaaggctgcttttatgaatccctgcagaaaaataatttggttttgctttgacagataacagtcatcagcaaggaatttcattttactgaaggcaggcttagttgctgaaatttactgcttgggttacacacatatgcacatgcacacacacacacagacacacacacacacacacacacacacacacacctgagcccattttcatacaagactgagtagtgttgcttcttggtctggatttagagtagctgggaaaacagcatgaagagtttttacattcagaaaggaatgcaaaggaatgtaaagaatgccttccttccttttaaatctaatcttattactcccattagtgaatatttaacaataacactaacgctaatagcagacttggtcgcaacatcaaaagcaacaataccaaagatgaatataacagctttgctcagaaaaacttaaagctacgtcacacatattatctcatttatcttttgaaaatctcttcaaactgtaagagcatatttatctactttgagacatgttttatgggaaccgatttccttattactctttgcatcttctgtttaaaaacatggtctgtttttaacacacctcccagccagaacctcaactcataactcatgccattgacttccttgcatgaatctcaaaaacaaaaaccaactcttagcaattatagaaaccggaaacaaaaatgaaacacaagtaggaagttaaataacttcactgcatccaacaattgcttttgcctaaactgaaattaaataaatagacacacacacactctccataaaaactctgctacacaatttattaatgaacagtgaaaagaaacagaagccaaaagtgggtcaggagaaactgtttaatctaatagtctggaaattatattggaagaaacagatggtttcacagaagtcaatgttacctagaggagcaaggagcgattttctaggaaagaaaaatgtttccctaccctaccgcatatactattttcagcaaaggaggagtctatattcagcacaggaaaagtcccgatattggcacacttacaaaactgggactaagtggcagccatccacacatactcaagctcagacttggccttctgaatctgagctggaggtcaaacctagccctattttaaagctgggaacaacagaagccagcactacgctccagtgggttattgaccaacactcatgttcttgatacctaaggaaagtggtcaccaacaggtcatgggcagcatgacccttaatgtggctccggaccctcagagactctgtgggtcccaggcagcagcaagacacacagggcacatggagtcggaagacctcagtgcaagctgcggctctgtaagacaagaccaccctatttgtcaggctccctatttgtcaagcagaacaaaaaacatctctagacttgtaaggatgaattgagctaaagtatatcaagctgcattgcaaacaacacagcataagacaatgctcaaccactcagtctattctcatccccaccatctatgattcaccaaaacatgcagccaaattctccctagagtagggctcaatcaaaaagagaacatcaaagctggggtccttgaatgaccgatcacagccaaccaaatctcaaagccatacccgagggacctttggtattgtccacaatccttaagagtaaagaattgaagaaggcaagtctgagttctgattctagctcatcacacattcgttgcagaaccacgggcacattaggtaacctcactgagccttgtttcctcatttgtaaaatcaagatctctataaggattaattgacactgagcaccatgcatgccacattagctgttattactgttgctactgttaacaatgattatatcaataccagcagcatccaagtccactgctccatcacaatacatcagctgcagggatccccagagaggccagggagggcgcaggggcagaacagcctttctgccatgaagatgaaggactgtacgaggaggagcctcccaccggggtgagcttaaatttgcggaaatatagaaagtcccgccccacccaactctgaccctggggcctcttgcagcagtatcaagggctgcttagagcctcccttctagccatccaccttccctcctccagggcttctgacattttgctccaaggtttgtttgtttttacttagaaaaaatgccatcaacgtcagtgactgtatgctcagttctgctgaagagctgcaaatgttatagatggatttgttatgttctaaaactgcaggtatcatatttacagagaggtaataaatacctcattaaggaaaggcaaaacaaacacttcagagtacttgaggctctatctaaaggaaccccatggtgaaacccactttaaaccaagaatcctcctgtaatgcaaataagtactcatcccctccaattctcttccttcctttccctagtttacgatgttgggctcccctgtaaagcacccccctccctcccagaacctgcaggcaccagcagccaggtatccatcttagccagctccctgagacatcacagacttaagctgagtctgttgacacctgttctgtagtgtcaactgtaggtggggtggggacacagaaccaaaccacaacaccaagactgacttaatgggtctggtgtgcagctgggcatgggaactttttaaacaaactttgagaatcattgtgtcaccttgtatccttatttttattcctctggcctgtcctcccaaatatattccaagtcacctaaagaaagtaagttatgatttggtcataatacataggtaggtaagtaaacatttgttgaatttattttatactcaaaagatcacactagtataatttttttctgccatctccactcaaattaaaaaaaaaaaaattgtactccacatgatcttttaaggttctccaagtgtggtccccagaccagcagcatcagcattgcctgggaacttattacaaaagcagattctcaggccttgccctagacttactaaatcagaaactttgaggatggggcccaggactctgcattttgacaagccctccaggctattctgattcactctcaaggttgggaaccactcctttaagctaatgattagttttaaaggcttttctggagattgacattattttagatgaggccatggaactggcctatcatctcccttcacgaaatcagaaaggctaatagtgccaggatttataactagccattaggcacccaaacacttagctccccacaactttcatttcttaattttcagaatataatgtaaatcatgatccatttttttagattagtctttttcccagccgtgaagggagactgaaaggacaactcttataaacaatgattatcagctgcttctgtagttgtgtgtcagactaacaccccccagactggaggtcaaagaaaaactggacctgtagaaaacttattgcgcaatgtgcatgtcttgaataaggaatgtcatcctgttattatcatgaccacccaaaatttatatacagagtttaaggctagaatgctggtggccgaaagccaagtatgagcctggtcagcacaatgtcgaagaaaacatcccgaaaatcagttcttaaagtcctcttagacaggaaaaccacaaagatgggaatttgtaaaatgcagcagtgtggaatgatcctcgaaattgtaatgcgtgtcatgggaatgtcttataaggaggaacttaagaatagaaatagaagaagacaagcttgagaaaggggcaaaggtgaataaattacctttgaactttttcatgttgaagcccttcaatttagtttaaacccaccacagcacacagaagattcaggaaccaagaaagccaaagtgaaggctttgctgttcagtaaaactacaagatatcctgcaaagctccaagtgcttggtggcctagcaagtttcttttataactgctccaaactcaatatctcaatttattcttctataccgtgggggtgactccacctacctcataagattgttgttagtttgtttagaagagattaatacaacagtaggtgctgaataaaaagtaactctgattattacctataaaaaatgaagctctctactctcatacattgttgttggaaatgtaaaatagaacaaacactttggaaaacagttgagcagtatcttataaaggtaaacatgtatttagcataaacccaacaattccactcctacatatttccccaacagaagtgaaaacatccacacaaaacacttgttcgtggatattcagcttttttttttcataatagccccaaactggaaatttcccaaatgttcaacaggaaaatgattcaacaaattgtggcacatgcaaacaagggaatattactcagaaacaaaaaggaattaactcttgatacacacaacagcaaggactcaatacatacaacagcacagactccatgcataaaacagcacggactccatacatacaacagcaaggactccatatatacaacagcaaggactccatatatacaacaacaaggactccatacatacaacagcaaggactccatacatacaacatcaaggactccatacatacaacagcacagattgaactgcaaaggcattaggctgagttaaagaagccagaggcacacacacggtatgattctatgtacatgttattcaaaaagaagcaaaactattcaacagtgacacagcagatcagcagttggctgggtcagggcaggcacctgagggaactttctggggtgatggaaaagttttatatcttgagtgtggtgatagttctacaaatgtttacacctatcagaactcatcacccaggcacttcatatgggtgtgtttcatggtatttaaattatagttcaataaagttattcaaacaaatatcactgcgacacccttcagtggactggcagttggcgctgagctctctttcatgtgcggtggataagctttgagtggaaagagctgaaacactggattctgggcccacttactacttgttacctgccaaatcaatttcttcatctgaaaagaaaagaaaaataccttcctttcaactttcggggctacttgaatcatcaagtgagagcattattggagaatgctttaaagcagactcagcatctggctgtggggaactcgtgtcatcccaggtgcccagcacacccacctcctcctctgctttctgctttccttcacctgccaggcagtccctaggaccacctcctaatttctctttcccccactccttttcttgtccccactgccactgtcttgactgaggccacctttaccttgcctgatgactgcaatggtttctatatgtttcccctcccccagcattgccccttccatccttcctcattctaaatccagagaaatctttccagaatgagaatctgatgtcacctgcaccccctccatcttaaaaaccttcagtgcttttgagcttagactcctcagcccaacacctaagacctttcatcatctggccctactttcttctcccccaaagaacatgctccaaccaaactgaactgcctgtggctccccacatatgcagggttatctccgtgttttgatccctcccacaagttgtctcctcttcgtgaaaagattatctgcttccaccctcttctcccatcttttgcctgactaacagccaactgtccctggcaccaaatttgcataaaactccaaatccacctgaggatttcaagtcttccttgacacacagactcctccatcaagcctgggctaccaccatcccatcagtctccattactctagcatcaagtactggttcttcatctgtgagagagtttgaaccaaagtaaaataccaatctatagtctggtgctatggactgaattgtgtccttccaaatcatcctaacccctaaagtgactacatttggagtaagaaagtaatgaaggtcaaatcatgtcataaggatggggcacaacgtgatgggactagtgtccttacaagatgagacacaagagagcttgtgctcgctcctgttctctctttctcactctctctgtcttccccccaacccccgtcttccctccctccctctctgccatgtgaggacacaatgagaaggctgttgtctgcaagccaagagagccctgaccagaacccaaccatgctggcaccttgatatccagggtagcaacttccagcctccagaactatgagaaaataagcatctgttgtttaagccagtctgtggtattttattatggcagcccgagctgactaaggcaacccaggaacacctcctgtctagttcacccaaatgtccccaagacatggcatctggcccaaggttgaccttcaataaatatctgtggaatcaatgaatcctcttatggtcactatgaacctaagggcaaatcttcatgataaaatggtacattgttatgacttagagacacagattctgacctgaaaccgaattttcctctcttgaaaacagactagaacagtgttaagctatagaactttcggcaatgataaaaacgttctctgtctgcgctgtccaatagcagtcaccagccacacatggctactgagcacttgaaatgtggctagtgtgacagaagaacagaatattctattttactttgttttaattaatgattacatataaataccatgtggctggtggctcctgtactagtcagtgcaggactggaccattcaaggaaggcccaagccctgggcaccggcctcattacacagattgctctccgtgccaactgtccctggcaccaaatgtgcataaaacatagtcgattttcacagagctgacataggtagctttcaagtggtgttagagtggcctggcacagagaggctggcaaaacgctcacataaaaggcataacggggtaccgttttgcagaaattgtgatgctttatgggcctccatctgcgatgaaacccatcaaagggcaggttcatccctcggtgaccagagttaattgaaaatttaagacccaatcaaatcacccagaattgagatttttggcagcttatgtgcttcactgtaagattcctgctgctttcgcctctgccagccccacaagtgaggctgcatgttccagtatcttcaacaacagcactgagctttaagcaagggacaaactcaacagtgttaactgtgatcctgactttttttttttttttttttgagacggagtttcactcttgttgcccaggctggagtgcaatggtgcgatctcagctcaccgcaacctctacctcccaggttcaagcaattctgcctcagcgtcccgagtagctgggattataggcatgtgccaccatgtctggctaactttgtatttttagtagagatggggtttctccatgttggtcaggctggtctcgaactcctgacctcaggtgatccccctgcctcggccttccaaagtgttgggattacaggcgtgagccactgcacccagcttatcctcactttttggaaaatgcacatggcacccttcctacctaagccatcaggtggacatgggccaatacctccctgacttgtatttgcctaagagtcaaataagcatcgtctccatgaaaaataagtgtatagagtgtcatttaaaaatctgctatggttaaaaccttatggaagaggaatcttcttataccattctacatgataataagttttctaacaacaacattccagttggtgttaatgcctatttgtgtcgcatcttgcagtctggcatcacaagagctttgatgcccaagattctagaattctatattcgaattcttcccccaaccacttcctagcactgcctctttgggcaagttacttaacctcgctgagtatccatttccttgtctgcaaaaagaaatgagtgtatccacctaccttactgggttactgcaaacataaaatgacataagaagccacacaaagatgaatgttcatagcaacttaacctgtgatagccaaaacctggaaatgacccagatgtttatcaaccagtgaatggaaaaacaaactgtggtacaatcaaacaacagaatactactcagcagtaaaacagaaaacacaccaaacaacataaatcaatcttaaatgagtaagttgagtgaatgagaagagctaggttttgaaaaagagtacgtactatttgattccatttatataacatcctgggaaataaaatcagtgatggaggccgggtgaggtggctcacacctgtaatcccggcactttgggaagctgaggcaggcagatcacctgagatcaggagttcgagaccagcctggccaacatggcaaaagcctgtgtctactaaaaataaaaaaattagctgggcatggtggcgggcacctgtaatcccaactactcggcaggctgaggcacaagaattatttgaacccaggaggtgaagattgcagtgagccgagattgcaccaccacactccagcctgggcaacagagtgagacttcgcttcaaaaaaaaatcagtgatggagaggagattagtggttgtctggggttggagggataacaaaggggcatgaggaaacttctggggcaatggaaatgttctgcatcttgatgtgatgagggttttatgggttggaacactttaaatatgtgcaatgtagtgtacttcatttataccttgataaagctgaaaaatttctgaaacatgagagcaggccagtgcagtggctcatgcctgtaagcccagcactttgggaggccgaggtgggtggaccacttgaggtcaggagttcaagaccagcctggccaacattgtgaaaccccatctctactaaaaataccaaaattagccgtgtgtagtggtgcatgcttggaatcccagatactcaagaggctgaggcataagaatcacttgaacctgggaggcagaggttgcagtgagctgagatcacaacattgcactccagcctaggtgacagagcgagactccatgtcaaaaaaaaacaaaataaagaaagaaaaatgaggtgaggacgtaatgtcctatcacaggactgggcacatagtagcactcaacaaacgtcagctccattctggagaataaagaataatctcattagaactcctgggagaaaaacatgagagaccgccagggaaaggagtcagcatttagttctaggtttactaggacccgactatgcaagacaggctcatctcagctagaaagctgaacaaggaagacaaacagaaagataaacaaggcttggtccttgccctgagggaaacacaaataggtttaatatatgatgtaatcaaaatgtcaaaaggacagtattgacaaactacaggcgtgcacaagagactaattctgatagaatggttgtcaagaaggaacaaatccaggtgggtggggtcctagcaagcagtaagaggtaggggcctgtgcagaaagagctgcctgcactgaatcagagaagcagagaaaggagggtcctaggcgggggcagtgggcacgacacactgtcctccagggaacaatagggggaggatctgggaagggcaagaccaagctacagaaagccctgagctctggcttgaatctcaacttcatccatccaggggaaccccctaaagagttgtgcagaatcagatgtgtgttttacacaagcaggtcctatctacagggcaactgggcaatttatcaagagtgccgacattcgcatccctcaattcagtaattcctgaggaaatagtcagaaatgtgtacaaagatttatggacaatattgcttatcacaacattatttgtaatagcccaaagcccaaaataacttaaatgtccaataaaaggggactgcaaaataaattatggtacactgagtgattaaatcatatatagccattaaatcatactttccgagcataggcatgacaggtgcacacctcactgtacaatgttaagtcgcataaaagcaggattcaaaaatacatggtgagtattcactcagcaaatatttgctgattatctatttaagtgccaggcactgtcctaagcactgagggagcagcagagaataaaagagagaaaatccctgcactcatgggaagggattctctcttctaatgaagaaaggcagacaacaaagaggaaacaaatagcaataagcaagatatatagcaggttacatggtaagaagtgctatggagaaaatcaagaggggaaagacatggagaattggggagaaggtagaaattttaaagaggtggtcaaggaaagtttcagagagaagggggttaagaagatgagcagggggatcctgggggaggacttccaggcagaggaacaggcagtgcaaaagcccagaggaggcctggcaggttcacaaaagagcaaagtcaaagcagcggaacaccaaagacaagcagtgggagaatgcggtcaaggagagctatgtcactcctggtgtggtggcagccacaggagagctctgagcagagaactggcaggatctgtaggaggacgagggcaggagcagggaggccacgtgggatatcccccagtgttgtcctagctcattataatgggtgtatgtttatttcataagcagaaaacaaaagataattccatcaaggacagcacaatgcacaaaagcagtgtggatgctgcagctgaagctcagggaaacaaacaaataaggaggtcggggaaatcattcagagaccagctatgaagcagtggggggacaaagcactgcatggaaacttcatgtgtttgtgaaggttcttaggagcaaagttactcttcgtcataatgaaaaacacataaccacgatgcaaaaaacaaacaaacaaacaaacaaaacaaacaaaaaaaaaaaacaactgcaaatgggagaaaaaagaattcccccaacatctcagcatcctaatacttaacatcttgatatacttcttttcaatcctttctcctagacacgcttttgtttttccctaatcctcccgcaatgcccagcacattgtaggcacttaaaaattcactgaacaaaaaaatggagggccaaatgcatgaccaaatgctccaaataattgtatgttacattagctatattagaggcatttacagacatggttttaataggcttgagtgaaggaatggcaactacacacagggggaaggcatggtcataggtatctgcacgtttaagaggatggtggtggcatgactgacccatcaagggcaccggaagggagcaatctgaaaaggaagatgctggcttcagttttggtgacttgttgagggggatgcacagaatgtccctgcagagacactcagctgtcctttttcagagctcaagaagcaattggagcctccgcacggagacagtcacagcagaaagagtagtcaaggaggaggggaggaagagaaacacctgcagaccctactgtatgccagacattgtgctacgagcttcacacatatctaccccattctaatcttcacaactgccccatgaagtggacacccgtgttccttttatagatgaggacactgctatagatgaggacactgcaggactgggaagctcagtgatttacccagttgctctgaggcagagccaggactcaaatccatgagcatgagggcttttcccactcattctcctttctgatcatagaagcttaaagtatatccagaagcccagggagaaaatgtgttcagatgacttcattacatagtgcccagtttttgctctcaaactcctgggacccaaaaagaatagcatgttcttcctcttccaaaaacatgtcttatactgttttccaacttacaattaaaacctgtggagttcttttattcttttcatttgtatgggtctcctgtctcccatcagatagaacactccaagatgccaggacaggctcacgacttcccccccaacactggcccaacactctgcacacagcaggtgctcagcaaatgctctgatgctgatgctgaccatcccttgccagtcttctcgggctattccctgtttccttagtccttggacacttgtatggtaggtgacccgactccctctggctcagccaaggcaaagccaagcccagatgaatgagccctcttgcgagatggcagacaacaggcaggtgaatttgggtggagaggaagtttcatacgaggagagaaggcaaaccttccttctccacggagcttgctatgaaacagtctgcaaactggttggctcatgggccaaattcagcctatccatatgtattgcttggctcacacatgattttcatttgttaaaactgtaattcgttgcttttttttttttttgagacagagtctcgctctctcgcccaggctggagtgcagtggcgtgatctcggctcactgcaacctccgcctcgtgggttcaagcaattctcctgcctcagcctcccgagtagctgggactacaggcacccgccaccacgcctggctaactttttgcatttttagtagagacaggttttcactatgttggtcaggctggtcttgaactcctgacctcaggtgatccacccgcctcggcctcccaaagtgctgggattacaggcgtgaaccactgtgcccagacactattttttaaaaagtgagagatttcacataaaaatctggatctctgtaagccgcccccttgagacaggcctgcccttttcatttcttcacagcccccaccccatccagctctccaactgcacccccatcccctgcaggcccctgctggagaccccacctgcccccatccattcccaccccatgtactcaccagcactcagagtcgtgaactccaggaagcggtattcataggacacatctatcttggtttccacctgaggcctcttcaaagttgaataaatattcccaggccgtttttcatcacgtttctctaacttgttcaatccgcaacccatttcagcagctgctggccaaaggaaaaaggcggggaggtgatttttttctgagattttgtctttaaacaccctagtataaaagatgccgtaattttcctgaagaatacatgacagacctcagcccttatgaaactgagagtataatttaatataggacctgaacacagaggactgtgctcagtactcaggctggcttctccttctgctaagatactattaccagccgtcctgagatttttttaaatgacaccaaaagcatacctgttttatatcttttttccccatctgaggaaaataatacctcccactgcctcagttccactataatctgtatccatgaataaaaaatggaatctaaaaagcaatacggtgcattatagtgtcagcccatctataaaaaacaagagatgtgtcaccttcactgtggttgctaacacagaataagtcgttgttacagtttccaaactccgagtcctttctaccctcaacagtaattatttagacaggaaatttatattcataaaacatcctaaaagtagatggtggtatttttatgggccttgtctgaaagtcccctttttcttcgtttttagaccaaactgcaggaaataattttatacttccaagctcttagagagtcatcttagaccaaaatgaaaactgactgaacactaatagcagggatagagcaattggaagcagaaatccacgtgtattacagcaaaaatctgtagttccagtttgaaaagaaaataaagaaatgttaaagtaatgggcacattaaggtgagctgagcttccaatcttccatgggattaaaagcaatgaaggctctctgtttatttgggcagaatgactttcacgaaatagcttttcatccactctcccaacttcagcagaagagattttgcttctgtgtactaaggataaacgatgctttcctcctctctggggtaccactgctgccatcagaacatatttcacaaaaatattaaccagccaagaatatcacacacagaaacccagtgaccgcttccttttagagataagaatttccttttgcttaattcatttacaaggtacccagcttcctaaggcaatttggcaagctccagaaaaacaaactgaacctcagaaaagcaacgagggcatggggcgggtggagtggaaggagacggtgtagcgacaaccaggctctacttttcagtaattaaaaaaagtctgaaagaatggatgagaacaggaaggcttacttatgccttaataaaggaacatgagtatccaaagggccagagcagacatgatttatgtgcaatctgcatgaactgattacttgtaaaatactctgtagttctgcagatgaaacagctgatatgtaaaaggctgcatatttaactgctgaaaagcaagccggctggcatccactgggacaaagcagaaaagaaatggacaaggaagcttctaagtgttgggaacacgtagcccgtcaagatgtgcactgttactctctgcaaagagcccaaaggctcgccaagtcactcattcatgcagatttactcatgcctactacaggcaaagcattattagcgattcaaacaatgtggtctttgccctcaaggaggttaggctactacaagagggaggacattcaagctataacacaagatgggaaaatggcagggacctggattgggtatttgagatgggctttgctggacagatcccaaatttgatgacgtagagatggaggcacagcaagagcaaaggcatggaggcaggaagctgccctacctgaagggaaagggcaggcagtgtggtttggcaggccagagaggcagcgtggggtttagggtgtcagagatcccaccactagcccatatggtgcctttgtgagaattcgaaaaaggtgccccctcttctgaggaatgcagccctgtcccagccatgtcttactgagcacagcaaggtctggatttaagcccctgcatccccccttgggaacaatctttataactgtatgtggcagtgctgcttcagtaggggggaagttaagcaaaattgattatgattagttagccatgtaaacaaatatgggggtggaggcaaagatttcttaaagaggacacaaaaagctctaactacaaaagaaaattttgacaatgtgggctatattaagatttaaaacttctgttcctcaaaacccacattaaagagtgaaaaggcaatccagagactgaaataagctatttgcaatacatttgtcaagtggtgcactggtaaaccagctctccaagaaagagaggaagccccgatttgtagtttgcctatttctgtggtgtaaacacacccaccatggcagctttcaagctgccaaacatgatgccacagaaggcagagtcaggaagagatgctaaaatcagctctcaaaagccagtgtgtgttggctcctgcacactaatgcattcatgcaacaaaggactcacatccaccatgaatcaaagagcgcctaacaaattgataaggaaaagatacactacccaacagcaaacaggtgaaatgccccaacaaacacccatgaggatatgcaaatggccaaggaacataagagaagaagctcaacttcatgactcatcagggaaatgaagggaagaccacagtgagatttaacaggcatctaccagaatagctcgacattttaaaaactgataataccaaatgttggcaaggataagaagcaaatgaaattcccctacactgatggtgagagtgtgaattggtacaaccaccttggaaaactgacaatatgttggaaagctgaacgcatgcctatcctgtgacccggaaattcctctcctgggtatataccaacagaaatgtgtacatatgggcatcgaaagacacgtatgagaaagctaacagtagcattactcataccagccccatcctggaaaccgcccaaacaccttccaggagaatagatgaatacattatggtatattcacacaatgaaatattataaagcaacgaaaacatggaacctaggattacacactacattaatgaatctcaaaaatcaaaaaggagtgggggtgggggcagccagacacaaaaagtacattctttcttactcccgttatacagagttccaaaacaggcaacactcatctccagtgttagaagctggggtgccagttacccttgggagaacagtgactgcatagaggatgagggggcttctagggtaccagctttgctgtttcttgatctgggtgtcagtttgtgacgattcactgggccactgagcagtctctgtattgatttgtgtgctttcccatacttacactaaaacgttcaaaaataataaacaaatctgtgaccttacaaatgcacagatacatctccaacaataacgtgaggatggaataaaggcaaaacacaaaatcatctacgtactgggtctcaattcttctgaataaaaactgaagcaatatttacagtaggcatgttcatctgatgctagcttatccaataaagccactgtgtatacattacagagttctgagaaggcgaaaggactcttctctctatcaggctggtggcagcttctaatgggtagcggcaggttctccctactgggccctgctggagactttgatgggaccaaggctgaatgaggagcggataggctggcaagcaagggaaggctctcatgcccaccctgctgcatactcaggcagacctgccttgctctggaaggcaaggtgtttgaagacctccaagaaggagcttgttcctcaaaaatcctcccacttttgctaccttattctgtaaattctcatattagaggttcattcctttgaaatcagaattacctttcctaagtatctgcttttaaatgacaaatatctccatgggaaggacaagaaactaagctcctggtagccactaccactttagtttgattttattttgtctataatttttaatctatatttagtttctttgataaaggacaggttccctgatagcagaaaggagagggttaccaggatgagaagaaaggtttggaaagggttggggtggggatcagaagagtaccaagaagcattagaaaactcttgtgattcacaagagtttaaagtttcaatcagactcccaaccttgaggcttctgccccagctcatcccaaagggcattgtgcttgatatcacaggacataaaggggctctgggcaaatcatccatgtgatcagacacagaaaagataaagagtatgttacattaaaccaaatttggcttgacgatgcctccatacttgagtcattacataacgactgcaacttagtttagtaggtaaactatataaaagcctaacttaggatgtaaacttctgtaacaaatagctgagtcttagccaatcacagcagcagaatgcagtcaatcacaggcagtgaattaatgtaaccaagccagctgtctctgtacctcacttctcttttctgtacacaaaacactgccaggatgtgtttcaggcaggtcactgaacctgttctggttctgaggctgcccaatttatgaagttttctttgctcattcaaactctgttaaatttaatttgtatcaagtttttcttttaataaataccagccagcagcaaaactgtaatatcattgaatccttgaatctcaaattttagagactgatttctctggagtgcgtgcaaccctggctaagcaactgtttctaaagcacagccctctttggaaagggagacacaggaagtagttgctggccatcaaaaccttagtgtgaattagttcctcctactcttttgtgtagaggcagctagcctgctccctgctgccacaccggcattcctttcatttcgccctggattcttccaccaactcccacccctgtcaaaataggaaagacttttacatcatttcaaaaatgtctataccatgctcaaaacaagtcagaaaaatctagcttataaaaagtaggaaaaatcagctgtaacagtgacttgcacactattgtagagttttgtagactatattatttaccatgtgacattcccaaaccatgctcacattagaatcctgcaagaggatggaggcaaaagatgggtatgttgcttttgagggcagtgggagggaaggcagaggaaaaggtctaaggaatagtactgtcagatgcagacagaagacacaggtgtgctgcacattcccgcacacagacattcagggagtgtctcagtagaaggacatctctcacatgggtcaaagtctctagtaaggtggaaggtaaatggtaagtaggatggtttttaaatgtggctccaaaatccactgacattcctcctattgagcctattgagaggtgaggtctatgtcaattaccctgaatctgggctccaggatggcttgaccaatagaatatgacggaataacacagttccagtttctggacccagctttaagaaacttgagagcatttactccctgacttttggggtgcctgctcgtggaatccagccaccatgccatgaggaagctcaagtagccccaaagaggggcccatgtggagaggaaccgacagccaggaccaacttgctggccatcttgccagcaggccatgctggaagtagagcttctgcctcagtcaagctgctgatgccatgttaagcaaagacaagctgtttcaccaagccctgccaaagctgcagattcctgagcaaaataagctactgttgttgttttaagcttctaagttttggagtggttcatttataccataagcaacttatataccaagtctgctcgaaatgaccatggcctgccgcctccttggcacctgctgaagttggcctgcttttaaggtccctgttacagccattcaccctttgaagggcatttgggttgtttctggcactggctgattatgaatgaagtggctataaacatttgtgtagaggtttttatatggacataagttttcacttctctagggtaaatacctaagagtggggttgttgggttatatgataagtgcaggagccctgttaatgaaaaaatgcttctctttacacatgtaggatgtccagatactgccgccatgaaaagtgtatggaaagtgagatctctcaaagatcagctagcccctgctcaactgaggcatcagcccactaggtggaatcatgcccagcggtgctattcactgactttttctctggttgttgcttgtttttgtaaaaaacacatgctaaaagtcacctgtgtctagtgagactcccccagtacttcatctatgctccatcctgctcccacagctccacccttccaaattcctatgctcacctcacactgacacctaatgtcaatcagattacctattttatgtgtgagttcattgttggatcagctttgattgacaggtgtccaggcatttgtttctctttttatattttgttttctcagcagacatccctgaaactatgtgtatgggtctcccgagcatcaaggtaccaagaaaaactttccaagaagtcttcaaaggtagaggaaatggaagaggtctttccccatttctatggtgaaacagtggggaaataatcaaagcatatatgcagttccctagcagaaattggtaagggtaattaggaactggatgctttctaaagaggaaaataaagtaatcagaagaaggttccgagacccgaactgcaagaagaagatgacagacattgcaaatgatctggaaacaaagatcccttgaatggtgatcttctggaaaaaattttggctgaatcaaaccttaagtgggatgtctctttggtaagcggtggatcagcttcttacaggagctatcagttccatgagggagggaaattatgttccaaattcattcatccatccattcattcaacacacatttattgaggtctgctttgagtcaggcacttggttaggaaacactaaaactgggaaggccaggccctgccctcagggagatcacagagacaatgacgagatacccatggtgcagtatggctgactgttcgggaagtctggacagaatgcgggagcattcggaacaaatcgctgttatataaaacagagatgggtgtggtgctgtgtacctgtcatcccagctacttgggaggccgaggtgagagagtcttttgaacccaggattgcgaggctgcagtgaactctgatcgcaccaccgcactgcaggctgagtgacagagcaagacttgtctgtaacaaaacacacacacgcacacacacacaaacacagcacagcgccaaatacttggctccagaagaagctgaccagcaatgcggcacaatgtcctgtgtcattttaaatgttgaaatgtttaaattattattttaaaagtatcctaatttgtttctgaaatgcttcccacgatgcccataaaaagactggaaaaccacttcaaaaggatcaccttcttaaaagactatttttcagctataacgtagaaaaggcttagtttaaaagttcatttttactatcaactagcatgcatgcatttaaataatgggggcaataaatgcagttatattttcaaatacaaattagcttcattaagagtaagccctcatttgccacacttgctgctaatctaaggcagcctgtaaagctaattttaacaaatgccaacagctcgtgacaagcaaccagagatggggcaattatatgcaatgatgctggatcagctggcaaccccattttttatctctacactcaaattctgtatttgaagacgcaagcatgtttattacttcattcagtcatccaaagtaagaactgatcatccaaattaaaaagtctttacatgataacgacatctctctagatccagaaatataaattaaacttaaaagttcagtagagtattcagatggtgtcagactttttgctgtcctgcaacagagtctaagaaaccctaggaaaactaaaatgtacccgtcgaaagtgttcctgatccaatgccagatgtaaagaacaatctatatcaaactgtattaacggtttatatggtaccactttttaaaagtgcctgtgtatttgtttataaaatccatacttttgaaaaactggcagttcataaaccacctgttagcagaacttttttctgagtcatgacactatgggctacattttcaagttttctttgttgagcatgcattattttcatggttgaaaacaataagaacactttgggaggccaaggcaggtgaatcacttgagcccaggagttcaagactagcctgggcaacatggcaagactctgtctctacaaaaaaatttaaaaaagaaattagctggacatggcaggtcccagctactcgggaggctgaagagggaacattgcttgagcctaggatgttgaggctgcagtgagccatgatctcgccactgcatgattgtgccactgcacgctactgcccagcctgggcaacggagtgagaccttgtctcaaaaaaaaaaaaaaaagaaagaaagaaaagaaaagaaaacaataaggatatcacagccagcctccaggacgaccctcagtgatcctcctggtattcacacccttgtgtggtcccctcccacagtgaatagggctgacctgtgtaaccagaaggatatggtggaaatgagtgtgatttcccaggctactttataggaaacattgtgggttctacctcgctctcctagatctctcgttctgggggaagccagctgccatgttgtgaggacactctatcagcaggatgaagttccactgcagggcaacgaggcctcctgccaacagtcagcactaactcagcacccatgtggaagtagatcctacagccttcagcccggccaacatcctcactgcaacctcatgagagaccctaagtcagaagcactcagttaggccatttctggattcccgactcagagaaaccatgcaagataacatgtttgttgttttaagcctccaggttttagggcaatttaccacccatcaatagataattaatccaggcagttcatgttaacagaagtcttgctcctatatgagaagtggcattgtggagtggttgagagctgactcttcagcggccaagttttggtgtaatttgttacacaataaaagatacctaataggagtggtgtttgcattataagaagaaaacacttgcttacccccactcctccaactcccacacctaccaccatctcagtctgtctcaggaggggtctgaacctgagtccatctctgctctgctgctctccagccacccttcgctaaaaatagctcccactcagaacctgctactcaacatgtggacctcagaccagcagcagcatccaggatcttgttaaaaatgcaggatcccaggccccatcccagacctgctgaatcagaatctgtatttgagcaataaatgatcccttaaagtttgactcacagtacagtttgagaaaccctgagctgtggcagtggctcttaatcttgactgcactttggaaccatctggagagctgttaaaagccctgatgctcaggcatttaggggtggggccagagcaccattatttttaaaacccccaagtgatgctaacatgcagccagggttgagcatcagtgctctaggagcaaacccagtcttttcccactcctagccctctccaatctcctaatagccaggactcagcagggcccaggatctctcctacaccctcacctccaggactgagaaccacagttcagagctcagccatacggatctgcttagttccacatccctcaatctcttgaatctctttctacctcagacaccccttcccagtctcctctgccatcctcccaggcaagcacaggcacctcctacatttctgtcctcctccatcctcttgcctcacttttccaaaattattttaattataaaccacttcaaacatatggaaaagtacagaaaatgagatgtccatggatccaccacctggatttcacaagtgcttacatttttaccttatttgcttcagatagtttatttttggataaatagacatcttggacacagtcctcatgccattccctgtctccctatctttctatccctgcgtgtactcttttacaatctatatataacacccagaacaacatatggcagagattctgaggatttctccgttcacagtgcccttagtttctctgtacattttttaatggcatgccctagactaaaaaaaaaatacccaatagttcgttttattaagtagttaggtccaaacaacttaatacttattcacagcctaacaacagcagcctttcagaaaaatagcacacataaactgaaagaagaaatattttttctttcattcttaactaaccacaattacttgctaatgggatgtgtgcatctgttggacactgagcaacttctcaaaacttggaaccacactgaacaccaccaccctcattttcagttccacactgattttcttagcaactacccaaaatgtagcttgtaaagatatgacatcatcaagagtaatatggtactgtcagatgttgatattgtgaagtgcctcaagctagtagttagcgtggtatctgacagatgttaagtattgctgcatttccctcaaagatgtgaaatatcccttggccaccctgtgcctttgctgcagtgccttgcggtatcttagcacagaatttgggaaccaccaatacatagtattatgtatgctcaaaaaagttacttacatgctattgtctctcccttagcactcacactccctctcttgccctaacttgacctgctccaggcaagagctccccagttcccttcccagcctgcctgtcttctctccagctccaggcagacatctccaagaactgtttcaacatctccacctggaactttctctcttcacctgagactttctcagcacttctggaagaatatgccccacagaatgcagcaccttgcccaacaagcttgctcttcctcctgcatttctcgtctctgggtggtaccactgccctcccaacatccaggcccaaaaccccagtatcagcctgctcccgccaccatcctcaccctgacattggcccatccagagctggtggatgctatccattcctccactttattctccaaaccaatctgccatcgcaacagctaccaacgctttcctggaatctgcctccccctcatccatctaattcctatctccagcttttcccacattaaccattttacaccacacaagtggctcaaagagcataatcacatctgctgtgcagcttggagtcctcagcctcaatctccctccatcctccctcctttccagtcctacctcccattgtttcctttcacagttgaccctagagtgaagtcaggctaagctactgcaatcttttgtacaccctcagaactctccaggcaccacccttttcctccagtggacctccacctgacattcctttcccgtacctctcatcttctctattagtcagggttctccagagaaacaaaaccagtcagatgtgtgtgtgtgtgtacccagatagagagagacaaatagaggtatttattataaggaattagctcatgaaattggggggctgacaagtttaaaatcttcagggcaggccagaaggctggaaacccagagaatagttgatgttgcaatcttgaatccaaaggcggtctggagtcagagttccttcttgtggatctcagtattttttcttaaggctttcaactgaatggatgaggtccacccacatgatggagggtgatctgctttactccaagtcttctgatttcaaagttcatcatgcctaaaaaataactcacagcaatacccagactggtgtttggccaaaaactaggcaccgtagcctaggaaaaaatgacataaaattaaccatcacactccttcaaggctgagctctaacaggattgccactctaggccattgattcatccaataaataagtaatgagcacttactatgtgcaaggccctgttctaaatgccagtgataccaaagtaaaacaaaagagattcacacaataaaagagcacgcctgccctcatggaccttaccttcagaagccgagaaacaggcaatagacaaacaaataaaaataatacacaaaatcccatttttaaagtatgccaactagaaaacaacaatgcaggggggagggatagcaatcacaggaggaggtatagtgttttaaatacggggattgggaaaggccacacccagaaggtgacgtttaagcaaaatcatgaggaaggccacagagcgagccatgggataagggggagggtgggctaggcaaggcagtggcaggtgcaaacaagctggggtgtggggcccctgggaggctgagcagacctcagggtgaagtcaaacagggctggggagacagagcgtaggcctggccgggccgtgagcacttcagctttaccctgactgagttggaagcctctggaaggtttcgagctgaaagaagacatcaattactctggccatgactgaccatgacagcagggaacccagatgacagtaagtagaggtgtgagcagtggtcaaattctgtatatgttttgaaggcagaaaacaggattgactgatgatttggaaaaaggggatgagcaaaagagggcatccaagacacctctagggttggtcaccagcacctgcaaggctggagtggccatcttctgagatgggtagaagaagccaggagttagccatgttaactccacccaagcagaggtatgcagtaggccgctggatgtaccatttcgagttcagaggagagctccacagctcttggtaatgcctcatctccctacatgacagtaaatttctggaaggcagcaagcgggtcttcttcatccccaacagcagctattccaatgccctgcccataacagatgcacaataaatacctacttagcagcatctttcgggaataggaaagacacttatctggtacaggatggtaaagggcatttggaatattccatctgtggctctcaaattcactttcttaacagtacagcacaggggttggtcatacaggctctggaaccagactgactaggttcaaatcctgctgcccttatttcctacctgtgtgacctcaaggaagccatttaacctcagttttctcatctgtaaaatggggacaactgcaatatctacttctagggtgaggactaaataaggtagggtgagttactatttaacagggctcagaagagctcagacacatagaaagagcagtataaatattaaccgttttagtactctactgggattacttgttgctcattatgaagacaccttttgacctactctggcctatagtcatgattatgccacactgaaaagggcacttataaggtatcataagacaccagaaaatcccaaaagacctctctaaattaaagaagtgtttaaataaacaacctgatttcttgtgctttatatttccaaaatttgctaatacatgatatgatcaggttccattaaccagagtctatgattaaccaaatctcttacccaactttctgagtaaaatctattacaacagttcccccaaatctgaggaactttagcgctattccataaaacttgaaggattcctcaggacaaagggtaaaaggcaaagtagggagtttcaaaacacacacacacacacacacacatacacacacacatgcacacatccacaaacacgcacatacatacacacacaatgcacataaacacacacatacacacacatacatacacatacacacatacacacaaacacatacacacatacatgcacactcacatacacacaaacacacacatacactcacatacacacaaacacacacaaacgcacatacatacatacatacacacacacacacatacacacatatatatacacacacacatgcacacatatgaaagctgataggcccccgtaaagaataaattgtaaccctcaaggaggtctgcctatggaacaacacgacgggacatttcaggtgtaaacgccagagaaagttgtcagtgaggtgcatctggcttcctggttgaagaagtgtggaaacctccaatacgggatcttaaagtagcataagagtttgtcggcatcaaacaactgagccaagcatagcttatgttgatttcccacttctggctggacttgctgcttgcagacacctgaggagtggcttcctctctcctgtgaggctggttctgaagtactgtacaccccagcagaggtgacagccacagtaccagccctccactgtcccatgtaactgggacatcaaagctgccagccttctccatcaatccctgcaccccggaggcaggtcaaatccaggaaaactctaaacgaagctttcaagtaccccaaatggtgtctcctccatctcagtcctggcagggagccatcactgcagaatgtcacctgattttccagctctttggttctggcccactgagagtgatttttcctcctgaattcagcccaggtagggagtaagtcacacaattgcatatttaaaagctgaactgaattcttatttggagagcaaggaattagccgggttcaagcagtggctatcgcttgcctgctgtaccaattttttatgagaaagtgtcttgataaaacatgcaatgctaataatgaaagcccctttggggcccaggagaaaagggagattcaaacgtatgtcaaaaactgaatgtgaatggaaggaaagatcacacgcacgcacacacacacacacacacacacacacccctttaaaaggtaaacacaaaagcaacatctggctaaatgtatccctttgtcagtgaaaaatagcagaagccctagccaagtgtgttaccaattcttaaactgaagggtaaaaaaaaaacaccacagagcagcactgtcaaacagaactttcagcaatgatgaaactactatctgtgctatccaattcagtagccactaaccacacgtggctctgggccacttgaaatgcggtgagtgagacggaaggactgaattttaaattttcttttcttttaattcattacatttaaatgtaaatagccacatgtaactagtggctactgtattgaacagttcagctggcaacgtctttctgttccttcaataaaattgtaatcctaatcaaccaataatattttaaattatcatcaaaattagtataagcccctggctgtgccaaactcagtaagcttaagacaaaatgaaaacaaacaaacaacaacaaaaaaaaactaaagaaaatgattgcagtgtatcatttcctgtaacgctgttctgattatctaatttacatttctattataatatggctttgtgtatttggaaatccgtgattgtagacagattttgccttcaaaaaaccagaatgtcacagtctcttcccttaaggtcttagaaaaatgaaaacgtgaacttagggaaagttaaccttgcaagcttcaatttcctcagggctgaagtgaagataatataagtactcgcctctcatgaggattaaattcagataatgcgtgcaaaatgtacaacagtgcctggcaaagggtaagcactcagcaagtggcagctataattatttgtattttattaacaatattaaaatcagtaataaagagaacagtgttaatacaatgaaagtttacactgaacaaaattttcctaggcccaaaccctttgaatgtgttttccaagccatggtaaagtgccctcgagtaaaatacatcctggggccctgacatcttgacacccactgtcaacctccagagaggcgatcacccagatgggtatcacgagtcacgaaatcactcagccaatgtttactgtgtccctaccctctggcaggcactgcgctaggcttttaaggaggagggaacagtccccaaacacagtgcaatgtctcaagactgagctgtctgccatctgactcctgcaaagcttggtcagccctgggacaccttgatgggatgcaaaacatgcatcctggggtcccactcagacagaaaagttcacttcccgtttcctagatcagccaaggcaagctttggctgttggcaccacagagagggactaagttattaggggacccgaggggcacaggcccattttcccagtcaggacaataagaggggtgttgacaggccatgtttctcactgagaggccagatcactttcacaagagagtcattctctgagtcttaacaaagccaaatctgacctgcccctcaaaataaacacaacccctttcagtagccggctgaccaagccggtgaaatccaaggggactctccaccaagttaatatcaaccctaccaatagaccagaaatcccccgggagtttctaggcagaagcttagtaaaattctgtggggcttggggttatttttctttttatagaaagcactcaatcaatcttctttcacaaccaagggtacattcccctatggaattcccttctctgaaaatctctaaaaataaaatattcatctgatcgtctgcaatgatttaagtttaaacccattttcaggcagagtcagggacttcctatggcccctccacctataaaaacatgttccccactgcctcagattccctctggccccagaagaacactagtcaaaccatgctcttgactttaggataggaaagacagggctgtagtatctggaatctcatacttgtattctttgctggtgagactgtaaaatggtataaccatgttgggaaaaggtctggcagtttcttttcaggtttccatatatctcctttttgacccagcaatttactactaggtgtttacccatgagaaatgagaacacatgtccctacagagacttgtacacaaatgttcacggcagctttgttcacaataaccaaagaaagaaagaaagaaactagaagaaagaaactaaaataatccatgtatccattaacagaatatacaaacaaactgtggagtaagacatactccggaacataagtcagcaataaaaaaagaccaaatcatggatacgacatggatgaatctcaaaaatatggtgagctttacacaatattgcagaattccatttacatgaagttcaagaacaagccaaactcacctatgatgagatacagggcagtggttgccactgagagggtgagggcagagaatgactgagaatgaggatgaaggcacctgctggggtgacagtaatattctctgtcttgataaggactagggttacacaggtgcatgcatctgtcaaaacattatgcaaatggtactttccatctttgcacatttcactatatgtatataaattttatcttaaggaaaccataagcacatattgaagtcaaaataataaaatgtgtactaaaatgtttaggaatgacctgtaccaacatctgtaatttactttaaagtgcataaaaccatcagctggacttatggatggacacagggatggctggatggttgggggaggtgtgtagttaagcaaagatggcaaaatgtgaattagactctaggtgtgtatatttagggggtcactgttcttgcaacttttctatatcttaaaaaatgggatggggatagagtcacagtgtcctctccttagtccaccaagttagaaatttggcaaagcaccatgccccaccaagccatgggaccacatagtttcaattctgctgaaaagagaagactggaagaacataagtagctttacaggaactcacatcactcatgccaaagattttctgcttgtttccctacagacaaagcaattatttgaatgtaagccaaaaattcctgctcaagagggagaaaaagaactcactgacttgtattcccaatttattatctttcaattcctgtaccaaatctactagctaactgcacaacactccacttccatttgccccatgtccatacagccaaaaagcaaacaaagaaaaaccaacccagtgacttgatatacaaatgcagccagaggatgacgtgccagctctggggctttgaatcactcaggcgggccagaaaccccactgaaggcaaaagaggatgcagagctcagtctgaggttagagtgatttcactgaggttagcacacacgcaccaaagagtcccaaacagcttgcttcgtaacccctctctggggtttggtgacatctggggtcacttgaacttcgttgggattcagctgttcagagatacaaattaggaatcccggcagcagagaggccctacccacaggcccagaggtcgctcacattacacccggcttccttcctggcaaggccttaacttatcctgagatgacacacgatggcaggggttggaagatgcctagtctagttgagcgcccagctcctgaaacagctgtaccgactacaagggttccagcacatgagttgctggaaactggggtgaccactgacagagattgagccagactttttttttaaaaaagtacttcttgtttgtttgttttaagcccccgaagaaactcactgacaccacccagcgtccctagggatcacccataaccacacagggcagctgagggcaagcacagagtcacagacagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtcgacaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttccgcccggtcacctccacgcggccgagctgcaagcgaccctggcagcctcagaacccaggggtcaggggctcatcgatcctccctcccagcccctcctaatcaaggttgtgtgctgtcaggaagagcgcctgggagacaaggatccttcaagatttgagccaggatgctgaaagggcgactgccatcaaggtgctgatggctgggggtggggttggggccgacttgagagaggaccatttctcgaccccattccacaggtgggagcatccctaaacatctcaggtgctgctgaaattctctcttgcgagttagtgcttcagggaagggtaatgccactgtctccgttgccatcccttggtctacctacttaagatgtccagaggtttgagaagatctggagaatcaccttgcgtggcaacttgaggcacccagggagaaaattatataaagagtgaagcactagtaaaccaggctgcattagtaaagtgaagatgtgaggcaaggagccattagaaaatattttcttcgtaaaactaaaccaagcagaattacagtgtaggggttaagagggggaactttaaagtcaaataatcagggttggattcctggctttagtacttactggctgtgtgactttgggtaagtgacttaactgctctgcgcctatttgtcacatggcacttcttcgtgggttattatatgtaaagtgtttagcaaccactctataacttagctattatcattattttaagggggctagaacaagaagggtgagataatttaattaattatctccattttctaattgggcaaagaagaccctgtgtgggcaaagttaagcactggagcacacagggtggagggctggtttaggggcccagcagtgtttcgatgaggtccttctggcactaataacactcctccagcaagtaaggaagcactattttgttttcagggactcttcctgttaccacagcttctcagagattttcttccttattttctctttccatagcctttctagttctgttttgctccccctccctcaccactgttttgtttttatttgtttttctcctttccctttccaccccaccttttcctggtgtcacactcaccaccactatccccagtgtcccccatttcccccctacacttgagcttgccacatgaaagaaaataagaccaggtgaccacgtaagtccaggttcagacagtagtgcgcagggacatttgctcaggggcatcaccagaggttgtgaacacccatttatgaagccaaagggaggggtcttcatgctatctatctgcccgaggccttgaattgctgcaagtcagggtccatccaaaatctttctgatcctttgctggtcactaggccacagaaagaaaataaaattgataggtgttaaccggtaggcatttaaaagaagataaaggaaaaaggagggtgggggtgggggaatgcagcataacctagttgcagtgtgcttgatttcttttaagcaaatcattttcactctataaaacttttgcacaccgttgtgttttttgtgctttttttttttaagacaccagtgcttgaggttaatatgctattctgattgcttccattttcttccactcaatattttcccgagtgctaataatcatgggcaaatgtcttaaatgacttttttccctgcttggatctgcatttttgagggttttctagaactcctgatcttcttgatattctgatgcttcctactggcacatagtaggtgttcagtaaatatgtgtggaatgagtggatgagccaatagcatgcagatctttcaaggctcttcttaacctgcattcagcaattatccagggtgttccaattctctttcacctggaatatttaatgaggagccaaatgttggattcacttgtgttctgtagagagctgcctggattttccacttgactgctatggactggccagccatgggagagaccctgggcagctgggtctcacttctaactgaccttgcctacccagccccaaccccaaagatgctgggactgtatcctagtgggttaccttggcaacctcacaatgtcatctgttagaatgtcctagggcggcagcttttaattctatcacagcggtctcatcgggggtcatgtaatagtgctgttttttctctgctcacacttcctccccctgtgatttaacactaagtactcggggaggagctgaacacgggaaaaaccaagctattactgcatgacaggtcacagatggccccagaactggggtcccgagtgttcacagtcaataagacgcaggtcccaagctaatggggaagctggatctcctcacaccccctgtggaaagaagaggagttaagccagcctaggcaagtgtaagaagctgctgtggccagactgcacgattcttgtaaaagctcagttaaaggaaccccccgctggaataattctttcttggcctcagcagcaccaccccactctggagatgattaaggccatgggtaccagcagccggagcaatttcgctgcatcctaactatgctgaggcttggagggaaggagaatcccagctaacctattctgctcaccttcttcccaccagaccccatccccacaatttcacttcacttaggtccaccctgctcctaacttagcccaaaataattcaattccccctctctgcagagagtaatcacagttcatagcagaaatggatcaaacaaaagctttggaacctgaagagctattgtcctaattgtttatgtacaggaccacgaaacccagaccttacactcgccagctgaacagcagagtttcagggctggtgggagacagaactagacttatctatgccctggaggtgcaataattattcatctttatcatcacagttaatattttaatgggtttgcagccacagtgagctcacagtttggccagctgctctgtactaaacagttataggaagctggccctgcatccggtgacaatcgtgcctgtaaggagccacggtggcaggggcctgagctctgtgccccaagccagtggttttggaggaggcccctgccctttgttcatggtgacaggcacagcctgcacaggcacgcccctaggaagaccatggcacccttggccacgttaaagcagagtacacttgtgccaaaacatgcttttgactccccagtacagtggagatgtgaattagggtgggggcagggagctggttagggcattttttgcatatgcattgatcagccaaggctagggacttttgtccaaagtatagtcaaaacaatactttgaaaatgccacccacagacatcaccaatttgaggaaatgttggatgatagccaaatgttccattcactcccatacaaaaaaaaaaaaaaaaaaaaaaaaaaaccaccacccacatttattgttattctgctcctgaatccactcattttacctctgaattcccagtctgagtcaagcagttcaggggagcaggggccctcctgtggctgagatggaatttgttctctggagcaaagagccactggagactgaatttcaggaatactgcgtgcaacacattgctatttgtagctttgtttccctcactcagcctgaggaattgtctgaatttaccaaaagccatccacatccacaccccttcactggttattccattcatgggacacatttgttgacttgcatttgagaactttattaccagagataagggggaaatgtgtgtgtgtgtgtgggggggggggggggtgtgtgtataaggagcctatacattctacagatgtcaaaataaggagatcataaaaataaatcatcattaaatgaatggcaggataacattttgatatattaattaatctgatttcccttccaccatcattcccccgcccccactgtatttcttgctacactgtacaacttgtatttcttgttcctgtacaactctcttcccatcaatttggacagccggaagtgttgtcaaaaggagagttatcataactccaccagaaaaaaagtcaaattcttggcttttgagttttggaagtcaatgtccaggcataaaacgaaaatacatggaaaaataggaaatcaggcagaaccagtgtcccgcagcatatctcctttccttttgctacccacccaccatcctgtacacacataccttcaaaaaatcaataaaagcttcacaactggagaaaagcaaggaaggaaaggcacagggaatatgttgatggcagcaactggtaggacacagtgactgaccagagtcagaattcagaaacccaccacctccactcaagtgaaaatcatccatccatagtatctgagaaccctgtggacagctgttcagctcttgggatttgtgcaggaggagcattatagaccttcagtagaggaaggaaacaggctgttcatccttcccattgacgctggacaatgaactcccatcaacagcagccagagcacaacccgtggatcatccagagaggctaactcctattccatgagttcaaccctcatttaatagcctagagtgctggtaagctcttgagatggacagcagggccctggaccctgagaagatccaagggtatgaaaagatgctcccacctacttcccatcacacctgtacgtagaagaacccgaagggaccagttcagtatcccccttacaaggtagcactgtggtgatcatcaatgctgttcctcgaatattcctagtcctccccttctggccccacagtaatggctgttcctggctcctatagttgggaggggctgtaattagctttggctaatgaattgtgagcagaagcaaaatgtatcacttccttaacaattaatcaactgttaggacaagaccattcagggctttctcttccttctagcaaggccactggcaaccttccatatgatggctgctcatctgtctagatccctgagtgattgtgagaagctgagcccccatctgacctatactctttacataacataaacaagaaatgacttgtttttaagccattgaaattacaagttgtctgtttctgcagcataacccagcctatactgactgatacaccttactagaatccattgaatgttcttaaaggcattatgagcatacctaggagctggaaggccaaaggaaaagatccaattagagaaacatttcccacattaacctggaatcataataattcccaaggtttccagttagagaagcccatgatcaaaaaactataaagagctgttatttactcattcatttaaggagtatttatttaggatctattctgtgcgctcactgtgtgctaggaataggggatacagcagggaataaacagacactgttcccgacctcaaaaagctttcagactagtaacacttggcagttatttactgcatgaaaatgaaactatagcctaggggaattgagagacttgcccgaggtgatacctttaataaatggtaaagtgggacttcacttgaactttatgagtctaaattttgtgctttcttcactcttctaagccacctaaaaataagagaatcagtataactttgagtttgctccaaggagtaggtggaatttaactccaggctaccttatgtctccttccttaatgtttgctgatacctgaaacctctttaataagccaaacttttcattccataattagtacctaaaacagggactgacaaatagcaggcactgtctaaatgtttgctgaatgaataaaacatgcataaataaataaatgaataagt

SEQ ID NO: 757 - DNA, 46136 bp, Homo sapiens
accgaggcagtaaactttattttcagggtccaagtaagtctaaaatatatgttttagggctgaaatgttcacattacaacttggatgtacataaacattttgcttacaattttttctctaagtgattcttgctttaaaacttcatttctttctacctaaaatcatctttaaaattcagtctctgcaataggcaactatttcttaaatataactcaaaaggcattaaacatcaggggaaattttgataaattgggctacactaaatttaagaacttccaaccatcagaaggtaagactatgaaaacgatgtcacagacttgagagggcatttgttgataagtacatctcacagaggattcacaggacataaagaacccctccatgccaataggcaatgtcaacagctcagtacggaaatgggcaaatgacctgaactggcagttcacaacagagaatgcagtcacgcaccacttaatgacaggggtatgatctgagaaatgggttggatgattctgtcattgtataaatatcatacagtgtacttatacaaacctagatggtatagcttactatacacctaggctatatggtgtagtcttattgctctgaagctacaaacatgctcagcatgttactgtactgaatactgtagacagctgtaacacagtaaatatttgtgtgtcaaaacacacctaaacatagaaaaggtatagtaaaaatatggtattgtaaacatataatataatataattgttgtatgtgcagtctgtcattgaccaaaacatcattatgtggtgcatgactgtatttaagtggctaatagggatatgaaacgcagttcaatctaaaaccacaatggattaccactacacacctactggaatgctaaaattaaaaggctggccatcctaagtgttggagaggacatggaacaacagtaactccctatctactcaatcagaacacatagagactctatgacatagacacacactcctgggtatgtagtaaacacaaatgaatgtgtgtgcttaccaaagataatgtgcaagaagggtgggcactgtggctcccgcctgtagtctcaatactttgggaggctgaggcaggaggatcatttgaggccagaaattcaagaccagcctgggcaacacagggagaccccatctctacaaaaatttttttaggttaaccaggtgtggtggcacatatctgtagtcccagctactcaggcggcggaggttggaggattgcttgagcctaggagtttgagaccagcctaggcaacatagtgaaaacccatctctataaaaaacacaaaatttagccaggcatggtggcatgtgcctgtagtcccagctacttgggaagctgaggtatgaggatcatgcgagcctgggaggtcaaggcagtggtgagccatgatggtgcctctgcactccagccttggtgatagagtgagaccctgtctcaataataataataataatatacaagaatgtgcatagtaaccctacttgtaattaccaaaacctggaaactgcctacatgtctgtcatcagtagagtggcacctctacaccatgagatgccacgtggtgatgggaatgcatgaaccatgatggcacgcaacagcgtggatgcatctcacaaacatagtagtgagccacaggagccagccagaaaagagtacaaactgcctggattcattgcataaagttcaaaaacaggcaaaacgcaaaactactctatgctgcttgacactttcattgacatacatcatacctatagaaaagtccacaactgacctggggtagtgactgcaagggaaattagcggggctgtgggtgctggtaagttctgattcttgatctgggtgctggctagacaagtgtctttaatctactatgaaaattcatcaaattgggagtttttgatttgtgcacttttctaatccttaaataaaaaatttacaaaaaaacctttacataactttgcccttcagctgatttggatcgcacactccctaatggggccctttcttctcctgaaggcatcttcctgagacttatagaagaagccaaggagctgagagcagcagagacaagaaacagagggagagtgagaaagtcccgggtaagtcttggctcttgtctctctctgagcccagctgcagtcccccgcttcctgggatttggttacttaatccaggaaattccccttttggcccatgctggtttgaaatgggtttatgccctcaacaatcaacagagtcctgactaatagtcccattagaggtttttcccaaaagaaaccgacttccttcaaaggcacattcaaactcctggctctaagaaggcagaaaaatgtgtttacatttatgtatgtatgtatttatttatttatttgagacagggtcattctctgttgccccggctggagtgcagtggtgcaatcatagctcactgcaaccttcacctcccaggcttaagcaatcctcccacctcagcctcccaagtagctgggactacaggtatgcactaccgtgcccagataattttttatttcttgtagagatggggtctcatcatgttacccaggctggtcttcaactcctgggttcaagtgatcctcctgccttggccttccaaagtgcgggattacaggcatgagccactgtgcccagcttgtgtttaagttttagaagaacagtacccacctcttcacccactccccttctgatcatcaaggttgtcaaaaagaaggctcgatctcaacttgggcacctattccacaaagattaggactgagcacttaactgatggtccatgcgcaggtgttaactcaatgaataggtgaactagatacggcacagtaatatggtagcaggaaatacacatcagagccaggacatatcacctcaggtgctggcttatattttatgaggatgatatagtatttctgggaacccttacagagctaacaaatattcagtcatttgtcaggtaagtggtataagctatctgattgcagagatagttttcaatattttcctcatggttacagttccagagcttgatgacctatttgaatgtttatagaaacacaacctttccaggagcagctgagagagcttgttgcaagcaagaagtgattgtaatgtggatatcactgcaggatgtgacatgacatgccagtggaaagatgtagcagatatcagcaggggaagtagatcagcagagtcactttaatgatgaaggctgtggaaatgtgtggaaatggttacagaaagcaggaggcagtccagctgtttcacagtgggcaggtctatgcaaacctgccacaaagtttgaggaagctgagaagccaaagaaagaggctgacaaatctggtttcatatatatatatatatatacacacacacacacgtatatacacacacacacatatatacacatacacatatatgtataaacacatatatattttattttttatatttatttatttatttattttgagacggagtctggctctgtcgctcaggctggagtgcagtggcgagatcttggctcactgcaagctccgcctcctgggttcacgccattctcctgccacagccccccgagtagctgggactataggcgcccaccaccacacctggctaattttttgtatttttagtagagacggggtttctccgtgttagccaggatggtctcaatctcctgacctcatgatctgcccgcctcggcctcccaaagtgctgggattacaggcgtgagctaccgcgcccggccatatatatatatatatatatatatatatatatatatatatatatatatatatatttaaacagagtcttgctgtgtcacccaggctggagtgcagtggcactctcgctcactgcaacctccgcctcccaggttcaagagattctctcctgtctcagcctccctagtagctggaactacaggcatgcaggcatgcaccaccaccatgcctggctactttttgtatttttagtggagacagggtttcaccatgttggtcaggctggtctcgaactgctgacctcaaatgatccacctgcctcagcctcccaaagtgctggaattataggcatgagcccctgtgcccagccaaatctggtttcttagaaagaaacatttaatagggtcttaggaacagaagccatgtctacttctccagtggcagcaagaccagatgggggatccctgcaccatcaccccccaagaccctgggcttatataccacaagggaggggtgggttagaagggacatgtaggtcaattgaagtagataacatcaaggttgcttgatctaagggcaggatttatggtaagtacctgctctaaacaaggaacaataaactggaaatcttagaggacttcccagaacagcggttaatcagaagctaacatggtggattaacttccaggatggagctgttgtagcctcaacaccagcttacttacagacacaggtaaaggtcctcagatccccaaatgcccatgaggacagagctccacaagtgatgccaacctcacagagcaagggctctgccaggcacaaggtgccatctgccaataggaggggtgaaggggtttattgctcctacttctagccctgcaaccccaagtattttggagactggctacatacctgtccacttaccaggtgcaaggtgtggtacagaataaccctagcacattcctaagagttcatcctgaaaatggatagggtaaagtcctatttcccaggggcacccatcgctgcaaagggtttttgccccacctggaggggcttggtaggatatctcttgccaaattacattccaaattgccttcacgaggccaggcctttttttttttttttttttttttttgagacagagtcttgctctgttgcccaggctggagtgcagcagcgtgatctcttctcactgcaacctccacctcccgaattcaagtgattctcctgcctcagccacctgagtagctgggattacaggcatgtgccagcatgcccggctaattttttgtatttagtagagatgcggtttcaccatgttggtcaggctggtctcgaattcctgatttcaggtgatcgactgccttggcctcccaaagtgctgggattacaggtgtgagccactgcgcctggcctcatcactcattcttatagcctttgtgccattaagcctggaccaggaagcaggggtaaatctctctaaggaagaggaaggtggtgacagcattaatgaaaggcttcatttttctgctttaagtttcaaagtagacttaaaatctgatagcaagacaatagtctcaaatgccagactttgcagagagagaaagggttttcttaaaacccccaaggctggggtttttacatatcaaaaaaatcgaagctcagagaaattgagtgatcattgagtgaatcatggaagaaagaaaaatgcagatatgacaaaagggaagtttctaccctacaggaagaaggacagctactttgagacttggagaaggagttaagaaatgggacaagaaaaggcaggccaggggcaggttgtgagtgtgctggtttttcccgccccacccatcaggatcaaagctccaggtgtaagagacgatagaaacactcagatagttttaaagactccacgaacataagggctggtgctcccacttccctgggtatagcctgaggagtcttcaaatctctcaagggagcctttggatcaggctaacgctgcatccaacatggtgcccaagtcacagagcagaaatggctgagggaggcacttcagtggcctgggcctgagacaactcacctgacatagaacgtatgggcttgcctgggcgcggtggctcaagtctgtaatcccagcactttgggaggccaagtcgggtggatcacttgaggtcaggagttcgagaccggcctggccaacatggtgaagccccgtctctactaaaaatacaaaaagcacacctgtagtcccagctacttgggaagatgaggcaggaggatcccttgaacccaggaggcagaagttgcagtgagccgagatcgaaccactgcactccagcctgggcgacagagggagaggctgtcaagaaaaaaaaaaaaaaaaaaaagtaaaataacatttgaacttgcatgagttgtggagggagcccaggagttcctgtgtgccaacaggggttgggggccaaaaagtatctgaggtactagctggtgatttcaccagaacatcaccataaagaaggcaaagtgactctataacgaagagctgcagaaaggactcctcaaaccagcaatcaaatagctttcccatgcagcccttggggatcaggagtcacagtgagagccagatgaggctgaggcagcaaggtaaagcctctaaccttgcaggcagcatgtgattgtgccacaaggccaagacctgaagctaagttagcttcccctgcatccagctgccatcttggaataaagcggagaaaggaaaatccttgcattggtggagagacccagacactatgtaattactcaaaaagagattattttaaaccagaggaggctgagataccataacagtaagatcaaaaattttcttgcatgcagcggaaatggggtttcaagagctggttgggatcttattgatggttgtgttttgcatatctgagcaaattctaccctgaccacaggatactcatgacttccataactacatacttattttttttcaattatgatggtaatatatatgatttcattgtagaaaacttggggggaaatactataaagaagaaaataaaaataattctgtaatttcaccagccatagataaccactgtaaacatcttggtttatttttttcccatcttttttctatgtatatgtgcatgtgtatgtgtatcactgtgattgtatgtgcatcttacttgttcacaagattctttaatttttttttttttttgagatggagtctcatacctttttctcaggctggagtgcagttgtgcaatcttggctcactgcagccccgacttcccaggctcaagtgatcctcctgcctcagcctcctgagcagctcggactacaggcgtgcgccaccatgcctggctaattgtttttgtatttttagtacagatagggtttcaccatgttggccaggctggtcttgaactcctgacctcaggcgatcctcccacctcggcctcccaaagtgctgggattacaggcgtgaaccaccgtacccagcctttggatctgcttttactgatgcgtgagtgtgtggcctcatcaccactcccagcagctggcacctgtaactcttctttgtagatccagtcttgggctgctggagggggcattgcctgagaatttacactcctctggggcagcccttcaccaatgactggtagaatgtaggaatgtaagccttgtccaggtgcacggggtgggaggcagggggattctgagggctatttatacttggggttccctgtggggcaggctaaagctattctccctgggactcagcctgagatgacgccctagcttggcttttctgagagcacatccttcataaatcacttgcacacaaaactcatctcaatgtctgcttctgggaacccgacctaagacagccagtgatacatttttaaatgttaagataaatatgaagaaaataagaggctctgtggatatatttaggaatttaaagttgggttttacagcttaagtaaacaaacaaaaaacagaatcatgtatcttgacatatcagtctggagtcagaaccttttttttttttttttgaggcagagtctcactctgtcccccaggctgcccaaagtgctgggattacaggcatgagccactgtgcctgacctggagtcagaactttaacagcagaaaaacaggagtggtactcctttaaatcacggacggtcattctgtgttttttggggagactgatgctaggtcccagtggtctcctgcaggggctggaaccaccccagagaaaggagagcaggcttctgtcccttcttgctgcacttgcaaataacacaggtcagcccagggccagaaccttggggcagctccaccgaaggagctgtcctgttgcccctgatccttccgtcccaagtcccaagcccaatcctcacaccaaggcaaggtggggaggaggcagaggttgtgggggtgtgggtgggtgggggtccttatgtcccacagtacgggagctggaccaggaagatggaatttgctaccctgagtgaccatagagagggtttctagaacctcaactttgcaggcaggtttagaaagtacgcttgtcctcccactgctaacagctggggaagtgcgtgtgtgtgtgctgctccaacagctcagaagtcctgggagcttttaaaaacttcccaatccaagttctgcctactgggctccagccttcctcagaaagacacttctgaaggccgactgctcggttcttcgaagtagctcagccagacctgacgacaccactggcctgcgggtagattctctgcagggccagcctgcacctcccagcaagggcaccacctggtggcgggcactctgtgggatgggctctctctctctctctctgttggggggggtgtgtgtgtgtgcacgcgtgtgtgtgtttaggtggagggtaaagtggatggggaggggatttaccctctgcagcctcaggcttccctggcaagccaccgccttggacatgacatttgctggcttggctggggccctgtggccagatgtcagaatttaagttctgcgcttagggcttgtgcaaccttagacattaaacgtctctaagcctgtttcttatcagtaaaaggaagatcaaagtacctagctctttgggttctttgttaaaaataagattatgctttggattcctcagaaatagatcctgagagattcagacataagtagtttatttgagaagtgactccaggaaaaaccacttggggagggcgatgtgagccaggagtggggaagaagatggcaagagtgacttatccagcaagtgttttgccactgagggcacctgcacaccatccctctcagtaggaccttgcctgaggggcaagggagctggggtatttatccacagattcccatcattcactgtgggaggaccactcctggggtgccttaatgcctcagctctctcattatttgacacgtgggcacggtgggcaccagcaaccagagaggatcctcagatagattcggaaatgatggcattcggaagttgggacaacatgtatggaaatggttagtggggaggggggatggctggggcaccaccaaagtcttctatatgcatgattaaaaattctcagaacatagtaacatttcaataaacaatagctatttataatagtacacatccgtggtccccggcaaagtgtgacacagctgataacctagaggtaggtccagataggctgtgtgccatgggagcgctaggcaccaacagccctacagcaggtgtttagtgtcccctcttgtatatataggggaactgaggctcatggagcatgagagccttgttgagggtcatgaggccgatcgtgccaatgttggtctcctgcgagctgtgctgctgctcccaccagtccaggactgtaaagagttttcatcctgtgtctgtgttaaaatgtgctctctctgagccccaccatgacagcgcagaaatttgtttccatctgtaaaatgtcaaggctgaatcttttatgttctgccctgggtctgtgcccgataatgaactccatccaagccctgtggctgcctccagcccacgagactctttggaacaaaacgaataattctcagtggcaggagagagtgagggaatggtttcatcactcttttcctgcacgactcagacctgagagaaaagaagagggaattggcagaaatagaaggcggcagggacgctctctcacttgttccctgcagtcatgcctgtatggaatttgggagtttgctggaccaggggggctgctttgggtacactgggagcagaaacctggggttccatcacctgcctcatggcggggcatcgagtctgctctcagctctctttcctgaacaccattgccacatctgtctgtgctggtgacgaaagagagagaagcctcaactgtctcctttgtactgcactaggccattccgcaactcaagcaggagaaaaacccaggagtggggtggcgtaggcggggccaccacaaggagcccgtgcatcagggggcgcaggctgtttctggatcattccactgggaaggggacaaaacccatcttttatgacccatgttcagttctcagttggagtcaggtaagcctttcccttattcttattattttaaaaatgttttctaaaattgtggtatgacatacataatatgcaattcttttatgtttgtttgtttatctatttatttatttattttgagatggagtttcgctcttgttgcccaggctggagtgcaatggtgcgatcttgactcaccgcaacctccaccttccggtttcaagcaattctcctgtctcagcctcccaagtaattgggattacaggcatgtaatcccaccacgcctggctattaaattaatatttaacccttttaaaggatatgatttggtggcattaattacatccacaatattgtgaaaccaccaccactctctggtttcaaaacttttttatcatcccaaacagaaccaactaggctataagatagtcctgggtgagccaggtctccagttgggacatgtgtttctaaaggagtgtggagaggaagtaaactcttaggtatgttttcctttaaaatcatgacaacagtacctatgggagaggtactgttattattcccattttacagaaaaggaaactgaggcctagaaagcagctggccagtgccagggctagtatttgaaatagactagtctggcctcactgggcaccacctccaccccacctggctggtcccacttctcactccattctgctggaatcattccatgagctaaaatgtctaacgatgttgggcctttgacttccctctgaagggaattggtaggctgagctgaatctgcagggtttcggccatctcatctggcaaattaagtgtgacatgggggttccggaatgaagtggatgtgaattgtaaagaacacgggcttatttgagcctagaatcgggccagtcatggatctgcattgaaaagggacttggggagctgtatgagtggggctgggccattcctggagtggcgaggccttcctggaggaccccacatctgtttgctgcttcagcacaggagagagactctttgaggggatgcaaacctggagagtcccctccccacactgaaggatcagaaaccatggagggtccttgccccagtgcagcggcagagcctgtggccccagccctacgcggtgctgggactctccatttcagtggggtggtcagaggggaggcagaaggccccgagaaacctttccttcaacatccccagggccccagagtgaaccagactctaggtggtgggagaggggatgcttgcaaaagatcaagaacaacagccctgaagattttcaataatcagtattagtaaacctcactcatgaagcactttctatgtgccaaggaacaccctaggggttcttcataattactcttcccaactctctggctgctgggtaggtattattttctctgttttacagatgaggaagagaatgcccagcaaggtaaaatggcagagctaagatgcaaacaaactcaggtctgcaatgcccaaacccctgttcctttccctccttgtatctgaaaactcttcttggcaccaggggaggtgcatctgggagtggctgtgtctgcctgcatgttgatgctggtggcatgcacgtgtgtgggccaggaggtgggtctgtgacatcctgggtgaaaggcagtggagcgagggcttctctggcattgctgatggctacctgaatctcctgtttctctgggccggctctctagcagccaggtggggacgcacatctcgatctgccctcaggtgctctaaaccgaggtgaaggttcacaaagccgccagaacagctgctttttccttgcagatgcctatctggagggggtgtctcttggcgacaggaatggcatttcccacagaggtgttggtggcgcttaaaaccccgtttagtcaggccacacaggaaatctgcccaatgttttctgagcctgggctggaagaggcctgcaaggaaaccacaggaacacacaatttttgctcataatgcaattcaacagagagttcttgaaggcctgtgtgggcacatctctgagacaccaagatggtaaaattccaggattctccccacacccagggaggacaacctagctgccccactgtgcactttggaggcacagccctcattagattgctgtgaggatttggaaggtcaagttcctggcatctacaacccatgctaatttcttctcttccttactttagagcatgatattcattgctaactgacaaagaaatcatttttaaaatgtgaaacatttcttctttcttgtttacctcattgacttgaaaaaaaatctttactccatggccctggtcatttgaatagaaaaatgcaaaaatcataatgattttatagattattagagccacgcaaacagccaatttagacaatccagggcaaaatacattctgatatcttaagcatcctcttttcttacttgtacatgtttccccttcaagtcactcagaaaaatgagaggacttggcctctgtttcagtctacctgctggaaaaatcctcgagggaagtgtctttgtggtggatgtggtctgacttggcctggaagatggggagggaaagcctgaacacaaaactgcaggcctgcgagggactggggccttacctgccccaatccccttgttctgtagaggaggagacggaagctcaagctgcagccaaacagctcatgcatggcagggcaggtactgcaagcaggtgtcctggggtcctgtcccatgctattaccagcctgctggtggcctcagcaaattccctaatactgaggggcttcccttataatgcacatactggggaaccaggactttgcacgcaatgacagatggcagggacttctgacctcattagggagggccggcatgacaaagccagctgtacctcagtgggccccagtgcaggacaccagagacaagaccacccagccagatctcctcgagactggcaaggcctggtggtcagcattgttggccggagagggagttgaaactttgatgggcacatttaagcttcatgtcctctgggcaccccccactccaccattgatgggaatggcactgaagaacactgtgaggtctgcagtgaatgctgcaggcaccccatccacattcctcttacagctgctctgagtgtaggctgcagacttctcccagctgcctccccttctagagagctgggcccagctaaacggaagctgccagggaggctgtgctgactcctctacctagaatttgacccgtgattggttaaagtggaaatacaaaagaccagccctttgtctcaaggtgcagcaactgtggtgcacggcctgctccagaggttcccctggggtcaggctgaagcccacatcagctgagaccacgtgcttgctttgctacttcccctgccccattctgcttccctcactccccttctcctgaaagcatgccccaattcatcgcttggatgagactctccatctcaggctctgcttctagggaacccagtctaagtcacgatccattctggaagaccttaacactttccactgactgtgagagctgccgaatacattttgacccatgggtggttcctgtccttggtgattccccgacctctggtgagatcttttcctctctggcaagcctctggatgttctgacttcagaggggttctggctgcagctttaactcagccatatgttgtgacagctcttggagcagcattacacgggagcaatatccttcctgctaattggatctcagaattcattttcggaccaaagacatcaaataaacccaggaaatacgaagccgtttgcagttatgacttgagacgaattgagttgttcatcctctaaagttgtgttctgttccttatcagcctcatctgaaatctcagacacaaaagcagagatgtttctgccaggaggggcggaaagttcggtctggttttgatatgtgtctggagatgataaacttgggaagggaaatatagcagatccaatcctccctcccccatctccattaggtctttggccttgatagatttcaatatcctgtgcagctgatgtctgacccacgcatcaagaatacagccttcacacacctgccgtgagaagccctctatgaccttctgcagagggagggaactgcctaagagctgctgagtgcaggaatgcagggtgctaagaagcaggtacccagtttggggttaaaatatgtataatatatccatttgaatacccatcaataaatatcagtcatgctcacttttgggtgctgggggttattggagatattgattcatttgttttatgagtggtattttctaatttttctatgatataacactggtctagtaaagaaatacaagttttaaaagcagttatgcacaacacagttccttttttttttgagatggagtttggcttttgtctcccaggctggagtgcaatggcgtgatctcagctcactgcaacctctgcctcccgggttcaagcaattctcctgcctcagcctcccgagtagctgggattacaggtgcctgccaccacaccgggctaatttttgcatttttagtagagatggggtttcaccatgttggccagggtggtctcgaactcctaacctcaggtgatccacccgctttggcctcccaaagtgctgggattacgggcatgagccaccacgcctggccatttccattttttaatttgaataattacttatggtcacacacacgtgtaaaacaaaactgcaactacatgcaccaaaatgtttgcagggcttagttttgggtagtaggaagatgtgtggtcttttctttcttttttacttagcaaggtattctatgacttcaggcaatgctgtatggtaaaatatccattctcagtctctgatggacctgcacagtgttaaccaacacaggtcccctctcagggacatggtgatggccttgcactggcatggtggtatgtgcctttcaggctgagtgagacactggaactcagtgatccaaggagagaggatggagctagtccccttgggatagctctgcaggatagaagccagcagaacctgctcccagccaccaggcaggctcctgcccatgtgcccctcctgcctggagtcttcccatggagggtcctccatgtgcatgttctgctctccattctccccgtgcctcagcctccagctccagggcacccactccattctcccctgtgccttgcggtgggagcatttgggtctctcattttgtgcgagtgcggggctgatgagaaaggggatcatctttctgttcttagagctgatgtttcaattctcttttccttctctcctcttagttattgcctttccttctatttcttctgcttcttccctctccagtccaagggaaccgttattagtaatcatatttattatgattactgtataataatcatatttattattatcactattttctagtgtagtcctccctcagcagctgcagagttatctagaaacacaggagggaagatagggcgtaatgttaaattctatggtaagaaaatcagcatctatcttgcaagaacaaataatacatggaattaacttgagccagggaattcctgaggatcataaatattctgaaataagattccaaggtactacaatagcaagaccacagttctagatccttacacagtgtggatcatgatttaagtccagagtggctaccatagaaggcagccctataggtaggctggaaatcacaaatgttacccccgggatagaaaagtgcattggtaacagtggtggctcagaggggcctggagtgccatcgcaaggggactctgggggctctgtcaggttctaaacaagtttctccaacctgcagccacttgacctctagattggggttggggtatttggggggttggagagatagggccagcagccttctgtcccatgcccactgaccctcaggaagtctgataggactgccagtagcccagcaaggactctaatcacagaacaaaaggggtcctggtggggcacctggaaggtaggttattttctagagtgccaaaaaagcttgctgggaggcatgttgtctccatagtcaaaatgaggccttggcatgttatcaagatgccaatcattttgatttttatcactgatcctgtgaaagcacacaaaagaatgcatctttggcagcactctagtgctttgagagacagtcctgggaatgctcaggcaataagaacgccaggaaaatactaagggtgagacgaggagaaaggcctttaattgtcctgagtgaacagccatgccacctgtcctcagacgaccacaggaaatccccaccctcctcaaaataaccttgggccttgtcccatcccggggtgtggcagaaagcatccagtgtcagcacaggcttggaggatgcctaggcttggaggggatggtgcactggctggatcgattgggctgagggttatgtgatcttgatagctggaagtgaggggcagaaaagaaggcagcctcttagaaagaccagaaacagaagattgcggcgaaagcatgggggcctgctgtctgcagagaccttggctgtaaagaaaacagcaggagctgaccgaggacagtgttgctgtgtggggaatggacaaaaaatttgtaaatttaagttactcaccagacacggtgactcatgcctgtaatcccagcactttgggaggccaaggtgggcggatcccttgaggtcagagtttgagaccagcctgcccaacatagggaaaactgtctctactaaaaatataaaattagtcgagtgtggtggcaggtgcctgtagttccagctatttgggaggctgaggcaggagaatggcttgaatctgggaggcagagtttgcagtgagctaagatggtgccactgcactccagcctgggcaatagagtgagatgctgtctcaaaaaaaaaaaaaaaaaaattaagttacttagagctaatgggagatggtaagaccagacgggtgagcgtcttgaaaatgtctgagagctggaggcaagtaggaaacttgtacttggggtaagaaccagagaaaataccaagaacaagaatccccgcagaatggagccttggtgaggagaatccagcggaccttaggcgtctcctcatgtgtggaggctgcacaaagcagttttgccctaaaaccaaagacccagcaaggaagacccaagaagggaaggtgatgtctggtaagtgcctgcccacagtggacgcagtaagcagccgtgttccagtttaaggtttgttccccagcagtcccacacatggtgaaggggttcggcactcccagcccagaatgagccctgtattgcactgggagagatgtcccagaagaggcgcagcagagccgggaagggcgaaggcactgtctatagagccagtctgccctggggtggggagttgaaggggcgggggctgaacagaaggtctaccagcaagagaccagagggtagtcaggaataggccccactgagcacccatgacaaggtgcacacaagggccgccagccccagtgagctgggtgaatttgggcagttagcctctgttatcccctccttttcctagtggcttctccggccagaggaaaaggcttagctgtgaaatgaatgccatttacattgctcttaactctcccaatccttttagctcaaaacctcttaatctagctgggaaatggaggatattggcccccagaaaaaggagagaataggagagtgaagacccacctcttcatgcccctgatgttaatgaatctggaggaggggctaggccaggagagccgagatgcttgttctgacacactctccttgctccccattttgtttctaactattctcctatccctcaagattcctagaccgtggggatccagagtgcaaatcttccagattaagttctttagggatatcccctcctctatttttggaaagctaccaagctgataccgccattgtctgtcaaatgccccaggagcagcaggtagcttccagcatggccaggtggcatgggtgtcagaggaggagagtctagagccagcacttctagaatgatcctttgtctactcaccaaaccaagtcctgtaattcttctgggtggccacagatcacacaggtatggcagtgctgaaagtcgtggttatcattaatgttgctcactgatgccagttttcctctccctttggccaccgggaaatgtgaactccttggctcccttgtgatgggtggggccacatgacaattctcatcaatgagcagaaaggacgtgacttcctgcctggagcatactgaattgccagtgtgagaccctccaggatttgcttcctcctacctagatgatggcggccaccttgttgagccagagtccccataatctgggtccctgaaggattccaaagggcagaactcctgccacctttggacagcatgagcaaggaaaaaacctttttttttttttagacagagtcttgctctgttgcccaggctggaatgcagtggtatgatctcggctcactgcaacctcacaggggttcaagcgattctcctgtctcagccttccaagtagatgggactataggtgcgtgcctatagtgcatgcccggctaatttttgtatttttagtagaaatggagtttcactgtgttggccaggctggtctcaaactcctgacctcaagtgatccacccaccttggcctcccaaagtgctgggattacaggggtgagccaccgcgcccggcctggaataaacctttcttgcacaagccaccagaagctgagattgcttattactggagcataacctggtgtatcctgactgataaggtgatgtgagggggaaagaaacaaggcatcctcctttgattctggttattagagaactatccagacggaagagaaaaagtagaaatgtgtgatctgtgtaaaagaaatgcaaatgaggccgggcgcggtggctcacgcctataatcccagcactttgggaggccgaggcgggcagatcatgaggtcaggagatcgagaccatcctggcttacacggtgaaaccccgtctctactaaaaatacaaaaaattagctgggcgtggtggcaggcgcctgtagtcccagctacttgggaggctggagctggagaatggcgtgaacccgggaggtggaccttgcagtgagtcaagatcgcaccactgcactccagcctgggtgacagagtgagactctgtctccaaaaaaaaaaaaatgcaaatgagaagcatttttgtgatgtgctcctcatatgtgcctaatgaccacatggctagaacaattctgcacgttgttgggtaaattgcctgtcacaggtggggttcctcaagaagcagtctgtgagatagagatcactgtgcaagaggcttattagggagtgtggattaaggcctgtggaagggaaggaatgggaggaggcagacgtggacagagggagtagttcaactccatgaaatctccatggacacctcagccagccctgagggaagtcagtcttgaatggaagaggggcgggcgctggagggtagtggaggacccttcagagctgccccagttgtggccagagggctgggtctttctgcccctgtgttgatcagtcattggatgtggtgccccaggtaggaggtgcggctttagacagggtggtctcttccgctgaggcaagacccaaagaagactaaagtgttcagatctggggctggaggcagctctctggatgaaagcagaaaactcagtaaggcagccttcggcagcagctggatattaaacaaggggtatccattctccccaggagtaaactttctctcaggagaagcaaaaataactgacaatgatgatttatcctggggactccgctatatcatttgcaactcaagctggccccacgaagctttataaatgggctggaatctgggggtgccatgtgcacatgtacacaggctaaaatggcacacgtcttttcctgtcatagaactcctgacttatccttagtaaattacgtacttggaagcgtttcactactgagatgatgcaaatcaaactgactagaaaatacagaccccacagatgaacttgtcaaggcctgacttcctttacccagtgggcgactacagctgaacaagatcaaaaggacctacaggctctgtcctcactttctgggactaactagtccatcagtgatacacacacacacacacacatagcccagaacacacatgcacacatgcaggttccactggcaattctgaaagtcaatagatgttgatatttcaatcacccctaaaaggtagatgttagggcccatatatagaaagttccattaagtgcctgagtgtctcatttaaaattaatgctatcaggttctttggggtttgtagctacacaaaatctgacattggctagggtaggtcaacaaaacggtggaccttgagcagtgagctcctaattttcctgggaaaagaagtttctagtgacgaacaataccattcagggaggcagaaatcctggatttagtctcagctctgcctcgtgtagctgtgtgattgtagacaagatgctcaatctctctgagccatggtatacatcttggaaaaaagcagggagagtgattacatgtgtgtacaaagaatacataatgtgtctccagagttataaatgctatgattacattaaattgatcaaggttagcaaaattattgacttttctcctgccagttaccacagggttaaaaaatggtgatgcttacaacctacaaagatcaatactccaccctctcccctctcaggggctggtacctgctacagatatctcaggacctcaaagagtcaaaggggcagctgaagctgcagggcaatgacccagcctctccttcagccagattgctgggaaaataagcatcccatttatttgatataatagacatctcaagataaaaggagacaacctacatttgagggttccattccactagaacacagcagagcagttctcaaactggtaatgcataggaatgccttggagggcatgtgagaacacagattgctaggctttatcccagagtttcggattctataggtcctgggtggagcccaagttttgcatctccaagttcccaggtgatgctgatgttgctggtccagggaccaggctttgagaactatagctctagaccaatctcagatatgcttgcaaaatgaggacgagatggagcaagggaaagcagctttcaaagtctcttaaaaacgcttttaaaataatttttaatattaagtctctttaaggactttttacttattcttctgaaaacctggaagaatttgaaactactacacagcagacactgtaacatggaaaccaagagtgaggaaaatcttgtgatcattaactatttatcccccaagagtttatctttttaaaaaatctaaatgccaaaataatatctcaggttttaataccagcttttggaatgtgcttatctgctaaagttcatgcatatgaaaagaaatctacatgccttttaaagtgagtcattttcgtgaaagccatccagctcagaggaactattgattttaccattttgatgcttgcctgggtgttttgcagagcttagaacaatgagcaaaaagttaaatcatataaaactgtgtttgccaccgtgacaggtggggggtggatgggaactgagggtcagtgtggtgagatgcaagacaatcgccatcagggcaaataatactgtttccatctatctctcacagccaggtaaaggagacagaagtagcccttctctaacttttccgagattcccttgctcaggttttagggtaacgtcttgcaattctgggattccctttcccaaatcaaataaagaaaaagctacatacacatctctggaggaaaatgtctgtattaaaagccaaaaaaccacataagtacaagaagaaacgcccaccaggccacgtcactggatagatcaacttggaaaaggttcataaagttcattttcagcggtaacaatatatcggtgttaaatccttcccatgccctccccccaattttaaataaattaaaaaaccacaaatttcaaatacaactatgttcagatacaaagagcttctcttactacagcaatagcaatttaatctttttgttttgtattttttttactaaaactttcatttaaaacagttattaaatatataaaacaaatacacaggatttggtcattttctgccatgaatctagggcacgtgggtgcggggaaggagtcgggcagggggatgcaatagaggggaaagggccccatttccctcctctccgtcttcggagctgcgatcccaccctcagtccaagggcttaaacatctgcttttcggaactggaagcgcagcacaaaccttgcttttcaaaggcgctggggtctctcggcggccccatctcgggaagaggaactaacgataactacagcacgaagcacaccggccgagtctccggcgggaaaggcacccgcgcgcgcggacacaggacggacacagggaggagcggagcgggtcacttggtcgccacccccgaagtgacggccgcggcggcggcggcagcggcggcggcggcggcggctgcggtggtccctgcgggcactgcggcgggggtggctgcggtggtgctggcggtggtccggcgctgttccatgccgttgggcaggaagccggcgatgatgggcaccggccagatgagggcggccacgctccacaccacgatgaccagggtcatgaagcaggccaccagcgtggactcaatgggcttacggttcagccgccagcccggctcgccctgcagctcctccaggctgaagtctaggcagcagaaatgcagcggctcgccctgcagccacagcggcccgggcggctcggccgcggggtaggctggcagcgcggtgggcgccccggcggtggcggcggcggcgctgggggcggcggcgggccggaggcggccggtgcggcgaccgcgcacccagccgcagcccacgcagaggcgcaggtcctgctgcgcgccgcccgccgccagccccaggtgctcgatgagcagcggcggcccgacgcggtggaaggcggcggcgaagaaagcgcggccgtgcgcgttggtggagaagagcagtaggtcgcactggaagccccgcgggcggccccagcgcacgagcagcgagctcagcatctgccgctgcacgctgatgttgcacaggcgccgccgccgccgccgcctcctccgggcccgggcgctcggggggcccgggggccgccgaggccagcagccgcggggcgatgggctcgccgcggaggacgcgttgactgaagcattggagggcaccccgaggaggccgggcgcgtccgcggccccgccgcggacgggcggcagcgggcaggcggcggccaggagcgcggcgagcaggggcagcatggcctgcggcgggcgcctacgcgcgcgaggccggcggcggttgcatggcgagcgggcgacgggccggcgagctcacggtgggaccgcgggagccggcggccgggcgcagtgcgggcgcgccgggcgcctgccaagcccgcaggggcggcgcggaggcggtgacggcggctggctcggcgcggggatccctccagacccggttgcgtttggggttccccgccgcccccggcgccggggcccttgggctgccgcgctgctctgcggggccgggtgctatcccagagcaggattccccggctcggctccgcctcccgcgtgccccgccccgccccgccctccgctcgccaggctcggggactcaggggagggcggggttccacgcgccggggctgggagaggaatcgccggggcggggctgggtgcgggggcgcggcggagagcggatcgcccggggtgcgtgcgggcgggcggggaagcctgcggacgcgcccgggcgcccccgcgctccgggtgaatcgcgttctcagagggaggctccagggcccggagaccatccttttgtcaggcctgaggggagcttcgctgtctcgccttagtgctaccgaacctcctttgttttacagaaggggaaactgaggtcgagagaggggaaagggcctcgctaggccaactcatgagccagaaacaagtccgcgccactagctctttctgcctttttacggtgtctcttacctcaaatctgtagagtttggctgctttttaatggctccaacacagcagactcacttgggattctcctcgcagcaagcgaggaaaattccaagaactctgtggagtttcgagtggagagtgactggctggggggaatgtgagccctgaagctgtgccgcctgggggtcccgaggacacaggtcctgacaggtcgagtgagcgcgtgttcatgaaacagttgtaggttagaacccacgtcaaaggggcagttcatcccctttgggatattatacgggaggagggctaccaagaataacgtgtcaagagatcagatttatcacatttatattgaaaagcactttcttagtagttcggcccctcacacttggaaacaaacttcaacgacccttcatcattcccatcgttctttaggggacatttatgttgaattattatctattttattttagttggaagcccttgtactccatgagcaccaagtattcctgattcggagaggggaggggtggagggagcagagaaaggcctcaacaaaaccgccttccttctaaaccagctaatcctgagaggtctgccaagagtccagctacattgctaggcatcctggctgattacttttctggaagcttttgtccattgttttctaacaatgagtaaaatgggactgagaaagttgcaaaaacgcctcaaaataaagctccccaacttattccacctcttgccatctaagcaagccattattctgacttagccttggtttccccatctgagttggggggtgggtggtacctcctcacagggctgctgtgataatactcccaacccagtgtctatctgtccccagatgttcccacatggtggttgctgtgatgtggttactaacagtgctgcccaagttggctgcctagagtggtccttggtttctacagaaatggttcatttccccaaggggatgggactcccttttcgtttcagcctccatcacttttgtgcttggaagtggtgctaccagggagaacaatgtgaattttcctgcttttaataaaaatgacttctcctttcaacctttgcatatcaggaacagaagctgctcagtgatgtggcagaacagttttaatttaagccatgtgtctggtgaaccctgaagaacaggaatatcaagtgatcctgagggctgagggaggcctaatcttcaaggggtgcgttttgagccaggctgttgcctgtgactgcagatgacattctctggggtttcagtcagaggcagaggcttcctgagctttcctgagacactcctggctttgtctgtgcaggggggaaggcagcagcaaagggaaaagacaagagatctatttggggagccaagcagttccctgcaaagttgcgccactgaagctctgcatcctagcaacctgcattctgcccacttttccagcaggtgccgtcctgaggactccgtcacctcgccctcattcagaatgtaattacccttcaaatagtaacacagatcctactttctagattgatttgctatctttttggaatttgagaacagaagatagcgaggaagttattttctatcttgtttactactgttcccagcaacgggaaaagcacctagctcagggtagaggctcagtaaatacatttttgtttgtttgtttttttgagatagagtcttgctgtgtcacccaagctggactgcagtggttcgatctcggctcactacaacctccgcctctcaggatcaagccattctcctgcctcagcgtcctgagtagctgggactacaagcatgcgccaccacgtctggctaatttttgtatttttagtagagacggggtttcaccatgttggccaggctggtctcaaactcctgacttcaagtgatccgcctgccttggcctcccaaagtgctgggattacaggtatgagccaccgtggccggccaatacttcttgattgaacaaatttgcctacctctgactagcttccgcttgtttagtactttccacgtgccaggtgtttgacacatacacacacatcatctctaatcttcacaacaatcccatggatgtgatgcctattttaccatgagaaaactgaggctcagagaaggtgaatcacctacctgaggtcccacagcagttagtggcaaagccaggatatcagtacagtctccctcatctgaaaagttcattttttttttaaataaagaactagaggcatctcatctcatggcagtaggcatcaaggtctgtgcataagttaaacaagtatgtggtacaattctattttattttgataaaataaactttcagttgagttcctttttaaagatgtattttttataaatataacagccttatacaaaggttggaaagcagggaggaaacaattctaatcccagctacctgatgtctttacttttctgcctctgcatcattattcttttctgcatttttttcatattatctaaaatgtgcaaatgttacttctaccaaaaaaaaaaaaagaggaaaatttgaagtctcaccacctttctcaaccatgatctctttgtggtcctccctccagctcggcagggacctggagggccagccagggcaaagggtggtccatgctcgtgttggctgactgagtgagtctgcctactggtaaagaactctgcctgagctatcggctgacacctgttcataagctgtggttctggccacctctctgatccatcttctcctactttcccttcttctcttcacctgctctgttccagacatcctgacttccctgctgtttcatgaacacaccaagaaaactcgactcaaggcctttgcccatgctttttcctctgcctgagacagtgttctgatacctgtcttgcttgctccctctcttcctgtagatctctgctcagatgtcggctcctcagagatgcctgttctgaccaatctctataaacaatgcccattcccaccatccccatcactcctctttttttgagacagagtctcagtctgtcacccaggctggagtgcaatggcacaatcttggctcactgcaacctctgcctcctgggttcaagtgattctcctgcctcagcctccccagcagctgggattacagttgccccccatggcaccagggtaatttttgtagttttagtagagatggggtttctccgtgttggccagactgccctcaaactcctgaccgcaagtaatccacctgcctcggcctcccaaagtgctgggattacaggcgtgagccaccgcacccggcctccccatcactctccagcctcttatgcattgtcccacttctttcagtacttctcatcagctgacacacggttgtgtttttctttgtttaatgtatcttcctttatttgcatgtctgctccctcaaagcaaaactacctgttttgttcaatggaacagtacatggcacacagtagggattcaataaatagttgaggaatgagtgagtgaattcaatagactgagtcaacccagcaagacatgagtggcatcttagggagtggagatggacagaaccacctagacagtccttatatcaggtttaaggaagaaaggcagatgagatcccttccatttccccaaatcctgtaatatttataaaatgaatggaaggctttgataaatttctgattgtccataaaacgaggacagcacatttttctccatggactgtattgttagaacacaataattgaggacatcaaagaaaattattaggaatgatgcatggtaatttcattctgttcatttcctatgttcctccccagtattagctaatttttccttatactgcctattgaagtaataactttaaaaaaagatctctctgagttatttgaattcctttcatccagtgacctcagagtgtggcaggtacagcaattcattggttctcttttattatgtgggtggaattaagatatgattaccatatgttgtagactgagaaataagcaagaaccacaaaagaatcataacaacaggacggaaaaaagcagcagctagaagccagtggttcagctatatcaaagtcataggaggttgtcgtacttgtgttgagtgtgtgttttggggaggactgggaagtgaagaaaataatgcttttcatgggtgtcctcctgatacatcccatttctcatatgggaggctcgaggactggtttgcaggagcagctgaagatctgggcatctgccaggggccgctggaatggaagtctggaagcccccagtgttcagctgatttagaccctgacagtctcttgccctctgcttgcatgaagcatttcgattccccgcccccctgccccccccatgtctctacccaatctccagggtgtggacatttatccttcctgaccaccatggtcagaagggagggttgcctctgcagaattctggctgcagttacagcctgcacagttcatttggtaatcatgggccgccttgggacaagccgactgttgccagcctacattgttacttagacttaattctgtcttgcacattaaatgtttgcatgtggataccttgtgtgcatggtaggcagggactgctgcctgtatttcttttctgtagtcatgctgttcatctggtaagatttcagcaaagacattttgaggaagtaagaagcttctgctcttctggagagatggagagtgtctaaaagagcactgggaggaaagtggtgcccatgtggtacatgtggtgcccttcagttttcttgtcaatgaaaacgagagaaatgcctgctgagagagcacctctcctgggcttagcctgacgttggcacctttaccagatgatagctgtcccttaactggcagttacttgtgccaggcgctgtgctaagagcttgaaatgcatccttaccattgttccatgaggaagagatttctgtgccattttacagatgaagtaaactgaggctcagaaggataaagtgacttttacagtcatacaacggtggagccgagattcaagccttgtctgacaaccttgtttttcactgcagccctgctgaatggcctccatcatcactaacaaccttgcgagttggaggttatcttcccattttactgatgagaaaacaggtgcaggaaggctgggcattggacaaggaccgactcattggctcttcagccttccaggaatataccctgcatccagtctcaattcataaattctgccaatactgaaatacttaaggatgttttcccagtctgatgcatccttactgatgaagctctggcttgtggttttcctgctatcaagtgtgtctcctccactggtgtctttaatgctcagcatggcacctggtacagagtaggtgctcagttagtgctggtcgggaacctgggatacagcttgacagacacccagcctgcagctcccaatttacttaggagccttcacgtatgacattggtggatttttaaacaaattacttggagaggtacggaagagagaggggaaaaagtccagggaaactaacacacattgatagggacagaaaagtggtttctgtgaaacgactgctgtgaaacacttatttctggggttaatgtccatcacatgaacctaacagaatctattccttgaaaacaaaatgttttgtaatatggtaacatgcatttctataaatttgtgtgccacttaaagtaatttttttgggagagacagcccttaaagcaagtgatattttgtggtttgtgtatccaccttataacaaattaagatgacatttagcattcataattgtaaattctgaggatttcaatgttgcaaacctgagagacaaagctgcaccatcaaagtcaaggcagctggatgttccccatcagccactaaaagtgtcataaaaatttacttcatgctgcttcaaaacagcactaacattcccttcaaaggaaataattggcattccatttacagagatgcagaagagatgggggaagcaaaagcccattttgagagagtcaggaacattggaacacatttatcatggcctttcatgccttctaacctcagtccttcttgctggatctatgggctcctacatgcttgtgggacagctgaagtttgcttggatgtgctcattcaggcagatgttctgcctgacagtctcttcacgttgagattgcctcttggtcagtctgttctctctttttctactaaagtcctcagatttggggatttgagagagttgtgactatgaccacggagcctagcaaacctggcttggatacaccattttgtcttgttgtgtctcagttttcatgtctatgaaatgggcctaatagctgctctattgtgagggttaaatgagtttattgttataaaacagccagttcagtgcctgcacagggtaagtattcagtgagtccagctagctagcacttttagttccagaaagtactgctttttggaacactggcatgtggcttcttctctgtccttaccctaatgtggaaactggtatatttccacctgcatggattcatcactgtatgtggaaaatagggagggcaagctcccagcttaaaagaagctaaatttctatctacatggggccatccttggcaatcaagcaaatccagtggccatgacagttagaagagatcctagaggccacctaatccaaactcctgattttatacatgtggaaaccaaggcacagagaggggtcctggctgtaccaaagatcacaatctggttgataacaaaaccagggctagaagccaagccccttggccaactgagcatcaggcacagcgcctctctaagtatactcctttgcagtgctttcatagctgcactttaaaaatgaggtccagttgcaaagtgagagcaatgagcctttctaatttacttaggaaagaagaggaaaatgatggcctttataattgctggaatcacacttctaactagatttacagggtggaggattgattgcatgcaccaagagtgccggtgtattcagcaagcttccgttctgatgcaattaaggcttgctccttccagctctgctgaggacctgggtgagattccaggagactcaggtgtgagatggaagcccaggctgcaccagccctggccttaagtttgaataaatccgtggaaataggcaaaaacttggagcccatgttctaagtggggctgttgggtcatcactaggctgagcagaggagactaactgaaagagcattccagctacagactccagaagattctgggtaatttgtaggtggagccttcttgaccttctctaactaggccctggaccagtgaagaccaggtctggaaggataccaggttgtcttggggtttgaatcatctatgaactgtacagtcttgggcataatgcttaccactctgagccttagttttctcaactgtaaaatgagaataataatggagcacttgcttcacggggttgtagtgaggactaaaagaactaacattttaaaattacatgggaccgtacctgatatgtagtaagtgttcaaaaactattaaataaatgagtaaataaagacatgaactatatgcctggagactgtggaaactttaagctgatgactttgcctctggccacctggacttagagcctgccacttgctcatactccccctctggtgtgactgaacctgtctccacaccacatcctggttggggagggtggggctaatgtctctttctctcttccttctgcttgttcctgccatcacttggatccagtcctgggtcatgcttcctgttacctgggctgctgagcagactcctgcagtccttcacacagtagcagaatccccatgggactgcctgcttgaagctttatgccatggtcactcagggcctcctgtgccctttccctgctgcccaggtggcacctcgagggcagcctccatcttgattgtatctgggtttgttctgccctctggactttggagatgtgtgccatgagcttctccagaagagtccagtgctgccctgcagctgggcctgtggtcctggcctgctctacccacctcacctggcatggctcatgccttttggctggctgctgagcaagagatggagtgcgcaggagaaaggaatcagacctcttctgtaaccaaactcctgtggaaatctagaccaatgaagcctagagatctgagctgcccacttgtcactcaattgtgagtgacagtatggcaagaaaacacattatttacccttctagaggcaaaccaaagaggctcacaatgtcccacaatccaccaaaggcccagccatctctctgcccaccaaaacccatatcctcagtgacctctgtcccaagaagggacatctcccagggaggacccatgtggcctaaacttttcttctatgcccctgtggcctaaacttttcttaaatcttgtctattttagttccttgctcattgataatctggcgtcttgttttaagctccaaaatggcaaatcacttttattttgtagcctaacttggattgtctaggagtggttgttggagtgctatgttaagaaggaccctgagaaattgaaatactgcactgttagtgggaatgtaaaatggtgcagctgcacagtatggaagtttctcaaaaaattaaaaatagaattaacatatgatccagcaatcttactcctggatatacatccaaagaattgaaatcaggagttttaagagatatctgcactctcaggttcattgcagcattattcacgatagccaagaggtggaagcaaccgaaatgttccaaagacagatgaatggacaaagcaaatgtggtatgtgcatacaatgaaatattatacagccttaaaaaagaagaaaatcttactatttgcaacaacatggatggacctggaaagcattacagtaagtgaaatgaggcagtcacaggacaaatactgcatgattccactaatatgatggatctaaaatactcaaacttttagaagcagaaaatagaatagtggttggcaggggataggggaaaggggaaatggggagttgttgttcaatgggtataaagtttcagttatatgagatgatatggtttggatctgtgtccccgctcaaatctcatgtcaaattgtaatccccaaagttggaggtggggcctggtggttggaggtgattggatcatggggacggcttctcatggtttaacaccatcccccttggtgctattgtggtgatagtgaattcttgtgagatctggttgtttaaaagtgtgtggcaccttccccgtctctctcttggtcctgttcctgccatataagatgcctgctcctgctttgccttccaccatgagtaaaaactccctgaggcctccccagaagcagatgctgccatgcttcctgtatagcctgcagaactgtgagccaattaaacctcttttctttataaattacccagtctcaggtatttcttcatagcagtgcgggaacggacaaatacacgagatgaataagttctagaggtctgccatacaacatagtgcctatggttaacaatatggtatggtgtgcttaaaactttgttaagaggataaatcttatgatcttatgttaagtgtttttaccacacacacacccccaaaagggacacaaacttttggaggtgcagatgtgtttattaacttgactgtggtggtttcacaaatgtattcataggcctggcataatggctcacgcctgtaatcccagcactttgggaggccaaggtaggcggatcatctgaggtcaggagtttgagaccagcctgaccaacatggagaaaccctgtgtctactaaaaatacaaaattagccagacatggtggtgcatgcctgtaaccccagctactcgggaggctgaggcaggagaatcacttgaacccaggaggcagaggttgcagtgagccaagattgcaccattgcactccagcctgggcaacaagagtgaaactccgtctcaaaaaaaaaagtattcatatggccaaactcatcaaattgtacatattaaatgtatgcagttatttgtataccaattattcctcaataaacctgtaaaaaactaaaagtatgccagggccataagagggctcagggagaaaatgtgatgtactcagtactcagcagttattggccagggttatgagaaacgcagactgtagtgaatatctgtggtttatctgccctacatcccttctccactttcttctggaaagggcatccctctcttttgggtacctgctgcttattaactctgtgtggttccagtgaggataccaattacagtaccttgcttgctggttcagtgatggacatgtgacccaggcctagccaatcatgatgccccaaccacatagccacagtgatttgtccagggaacaagcatgtgacccaagccagccaatcagagatcttccttgacataaagccagaaaggaaggctgctctttcctctggaatcactggctggaggaagtgagactggagcagtatgcagctctgcccacgtctccctccactccatgcccctttcccttctcccggcacacagaaagcctataatagggttctgctctgtgtccccacccaaatctcatgttgaattgtaattcccaatgttggaagggggtcctggtgggaggtgattgaatcatgggggtggacttcccccttgcttttcttgtgacagagttctcccaaggtctgtttaaaagcgtgtagcactccccactcccatggccatgtgaagacgtacctgcttcccctcaccttccaccaggaatgtaagttttctgagacctccccagaagtagaagcccgtacagcccacagaaccataagccaatgaaacctcttttctttaaacattacccaggctcagatagttctttttttttttttttttttgggatggagtctcgctctgtggcccaggctggagtgcagtggcacgatctcggctcactgcaacctctgcctcccgggttcaagcaattctcctgcctcagcctcctgagtagctgggactataggcacgtgccaccatgcccggctaattttttgtatgtttagtagagatagggtttcaccgtgttagccaggatggtctcgatctcctgatctcgtgatccgcctgcctcggcctcccaaagtgctgggattacagacgtgagccaccgcgcctggtctcagatagttctttatagtagctcaagaacagactaatacagcctgtttgcagtaagaaggaataaggctaatggcaggaggtggcagatgcagaaaggcctgacattgtcatctgagaccctagatccagctggacttgaagcctgctatccctactgtgatcagattgtgggcttaaaaacttaagctagcttaaactgggtctcctacactgcaaccaaatacatgcaggaaatatctgtcaaccctcttgttgtcactcaagacaacttcagtcctaacagggttttaagtttaactgggaagccccttcacttcctctcttcacacccccagaggttgcctggctctagtcttagaaccctctaaaagcaagaagagtacttttttctcctcttaattatattcataagtgctatgggtaactcttcttccccctgctcaatctcaggagaaatttttgttcctatagcaggggtccccaacctccaggccatggacctggctgcacagcaggaggtgagtggcaggaaagcccagggagcaaagcttcatatgtatttatagctacaccctactgctcgcattaccacctgagctctgcctcctatcagcgcggcattagattctcacaggagcacgaaccctattgtgaaccgcacatgcgagggatctaggttgtgtgctccttatgagaagctaatgcctgatgatctgtcactgtctcccatcacccccagatgggactgtctagttgtaggaaaacaagctcagggctcccacggattctatattatggtgagttacaaaattattacatattacaatgtaataataatagaaataaactgcacaataagtgtaatgcacttgaatcatcctgaaaccatcccctaccccatgtgtggaaaaattgtcttccatgaaaccagttcctggtgccaaaaaagttggggaccgctgctctgtagggctgagcatttgaaccaaatccttcaacttctgtgagtctgtttcaaggtcataatcatgaataaagaaaatttttagctccaagatgtgtattatacattgtttatgatagcaaaaaactggaagaaacttaatgtctataaataaggggatagttaagtcaatgtagccatgttcacattatgaaatagtatgcagccattacaatggtatttacagagtttcctgcttagcgtggcattgaaagcactatgcagaatttagccctctcgtggtgttcacgaggagcattgaaccactgagtgcaagtgattgttcgtataatctttactgacactttctgtagttgagggagaggtcacattgcactggggcgtgcaattccactgtcaattctttgctatactcttttgttgtccacatcccctgcaatagtcccgttgtggggtctcagtctcttgtgtctttctcatgcagcacctagcctgtcttcactctcctcctgtcttgatttgctttaaggaaactcaaaagcctttcctgtcagtcacaaagagcaatctaaatctctcctagctcctccctcccaattcatcctgggacactccctccccacccaccgcccccaccagagccattcaagtagctagattctttctccttatgaggcagttgagccctgatttttgccactggagcccgtcctctgaggttcctacctccattgcaaatggccaggagggcttctcagacctaactgcaccagaatccttggagggttccagaaagcacaggtgctgggcgctgccccagcgtttctgattcagcacatctgggtgggacctgagaatttgcatctcgaacaaggttccaggtgattcccaagtgatgttgattctgccagtctggggatcacactttgagaaccactggcttggagtatttcttctccacacaaacaagactctccctaagaggaattttggtgaagagtgttttttccatcttgtcacatagtattatcattgttagagggtaaaaaactgacctaaaaatgctcgtgcctggagtgtctgcttctcagtctctccagaccaacagaaaaaaggatcacagaccagccatctgctgggtttgtttaaccaaagagatgcagatcaggacccatagcttggaaagtgaatttctagcacttaactagagccatacccatggtcaccaacccagagaagataccagtgttgggagcagatttaggcctgcatggggctggagtctggggccccaggagccaggtgagagaggtagaccagtcagcacaatggcagctatattcagttacctctgtgctagggcatgttggagatggccaagggcacagctggcctagctgtccctgcccccaaggccttgctgtctgttgaggacactggtcaagccagcatgtgcaaatatgcaggcaccttgaactcacggtggaaaagccgtgggtggtagaaaagtcccaggggatatgcttctagtcccatgagggacattagttagcgaagctttgatctggagcatgtcacattaccttcccagatgtgtcattgataaaacaaggggctcgcaccagatgatgacctctgttccataagactccacagccaaatggaccctcagggctggcatttcacttctctattaggattttcttttgggggagcagggctggatggacctgctcaaatgttgcgagaacttgggacagttataacaccttggtgtgttttgcagcctcctttgtcatgaggctcagactgctagagactctccaccctgtgcctgatccctgtggtgcttttattttgacaggtggacacaggtgttgggggagcacaggtgtggagataggggcatgcttcactccagatgttgggggtgcccagcacagctgacctgggttgaccccagctggctgtgtggtacatctgaaaacaggagtgctgggagaaaaagcatcaatggctctcgcttaggccactctatggatggcagaccagaccagaccatttaaaatggctgtggatcatgaagggagggactcaattgggactggactggggacaatattgcagtctgtgtacaagagtgtggctcctccttggagccagctgtgggacttgccattgcctgctatagtattggtgggaatttgggggtcatttctgcagtttccccagattctatagtcggactggtcccaggacatcagagaggtctcatctgccaacaggagctcttggtggccatgccagccttgggcagggccccctctctggtcagatggtgctgcccttgtgacttgagaggcaggcccacgctgagggttttttccctttttccttggctgtgtccccgttccccagtaccttgggattctcttggctgataactacctgagcacttcacacctcattgaaaagtcaccacaatacttaccagatcattaacaggagatttgaaaaggcacttcaaagcctctctcccagaattgctgagacaggtgtaagagtctatctgagcaaagagtagccagtttaaagtgatgttggggattcaaagagtaggtgttcatgaagctgggttgagcatcagcgggataggtaaccttctaatccgagcattgtaacaacccatgcagtggtgaggaggtctgacagttttagatgaaacacaaaatgtatggactttattgctcctctcacactttaatgaggaatttgaccgcaattctaggtcttcaaatgcctggtacttattttggcaagaataaacataaacaaatcattctgcaccacagtcttcataattaattttaccaattaaagttaatgaggtgatataactgcaaatcaaatgcctgaatggctggggttgggtgggcaggtaaactttccttctaccaaaaattctacacgaaggaagataacaaagggttgtttccaataggcagactgttaaattgcaacccgtagaagaaaccactttagtgaaactttaacattagtagttgcatcatgacaaacctgagtgttgtttgaatggatatacaagccttccctacctggaaaccttgttttcagagatccttgtccacttgcaagggatctctgggtagcaacagactcaagtgcagatctttatctttctgccagtggctaagtcagtgggtttcatttgtagctgcatgtcagaatcacctgggaagcttcttagtaacacagatgtcaagactcactcaagacatatggaatcagaatctctggggacagagacctggcatccacatttaaaaataactagcaggccgggcacagtggctcacgcctgtaatcccagcactttgggaggccgaggtgggcggatcatctgaggtcaggaattcgagaccagcctgactaacatggtgaaaccccgtttctactaaaaatacaaaaaattatccgggtgtggtggcatgcacctggaatcccagctacttgggaggctgaggcaggagaatcgcttgaacccgggaggtggatgttgcagtgagctgagatcacaccattgcactccagcttgggcaacaaaagcgaaactccgtctcaaaaaacaaaaaattttcagggtgatttttgtgccattttagaacgagggtgtttgggaactataggaagctgaaaatacttttagtgaggttttttttttttttcccatattcaaagctacttcagagcacaactgctttaaaatgtcacttctgggccttcagctatgttacctccaagagggctaatttgcaaggtgcctttcctagatgccagacaggaaacgtaagccaagtacaggagtgtttggactcgtggtgaccatctttcatgtcgtgcgatcatctgtctggcactgtgtaggctggaaacaaggtgtgaagcagccagcagttagtggtgtttcatatttggaagtagcaaactccacctaggatgtcctgctatctgggtatgacttgctaaaatgtcgctgtgtccatttgtgcatgagaccaagcatgctgtgtgggcccaggtgggctggtccaaactgcacaccccaccctagattgtctgcctgacccctggagggtgggccatgcagccggaggatgcctttccctacatccatggtgggaaaggtaggtgctgggcggccctagagggggcaagggtgatgggcaggaggcagtgctaggtaggaaggtgtcaccagctagatgggaatctattcttgggactctctcatggatcaacctgggggccccacctaagtctttcaatgtgctggtctcaacttgtccttttagattttattaaaatcacctcaaaaatctgtcccttggctgatagacacacaaatatctctcatgtatctctgggtattctgggcactcacatctctcttgactgcctctggccatggctcctgctgctgctgggcccccagtctccgccgtatgccgctgtattttcccacagactagcctgccaaccgactcagccccagtcttttcttacccctaaagttccaccagcccaaggctttgggtggagcaaacttccagacccaattcagagcctggagacctcacaaggatgtctttgacctcatcctgggccggatcctttacacactcatgctactccttgtgctttaaaagtgaagcatggctgggcgcagtggctcacgcctgtaatcccagcactttgggaggctgaggtgggcagatcacgaggttaggagatcgagaccatcctggccaacatggtgaaaccccatctctactaaaatacaaaaaaaaaaaaagaaagaaaattagccaggcatggtggtgcgccctgtagtccccagccacttggaggctgaggcaggggaatcgcttgaacctgggatgcagaggttgcagtgagccgagatcatgccactgcactccagcctggtgatagagcgagactccatcaaaaaaaaaaaaaaaaaaagcagcatacatcccactcctggcccaattcccctcctcatccagcatctcctcacccctcagagacctctgagactccacccgccagggcaacactgccagtgccaagacctccaggttgagagacagcggggaaatcaattgcagggggatatttcacccctctgtgtttctcaatgttatggcttcagcattaaaatcaaatagccagagataagattctgcaggcataagccaattatatgcatatgtcaggcaaatcatatgcaaataacacatgtgactctgccctggattgagtctgctcagatgtgtctcttagaagcaggctaatagagataattggtaaagtgcatttaaggtgtgggggccacaggggcaagaggggagaatggcgaattcttaaaccccaactgcaggccaggaagttttacatatgtcatgtgttcaattagcacttactccgtggctgctgtgtgtccagaatggtaatagggatagtgagataaatgaaaagctgtgcaccccaccggaactctcagatgagtcgggacacaaacacgatgacaagtacaggatgctgtggggcatgcacagaccatctgtctaaatcacactggggcatccagaaagcttcctggaggtggcgatgcctgagctgtgttttgaaggataagtaggagatgttaaattaaacaaggggaaaggaaaaaataaaaaataaaaataaatttaaaaaataaataaggggaaaggcgttgtaggctgcctggcatattaagtggatcagcatggtgctgggaggagtgcatgcaccaggtaggggaaatgaggggagagggggttggtgagatacaggggctggatcattaggggatcagcatggagctgggaaggtggagcttcatcctgaaaagtgagcatgtaagcaggagaataatgagataaggagatgcttctggaagctctcagactgcaacatggtccatgggctggagcaggtccaggtggggcaaagaagccaggcaggagggcttagaccaagcaatagtgggagagacaaggaggtggaaatcatcgggaagttatttaggatctcagagtagtaggactctctgatcagtcagttgtggagggtgatggtgaagaggaatcctgtatgattagcaggtttggagcttgggaggtggacattggaccatgggaagaaagcaagtgagagagcaattttattttggacacatttggtgtgaggagctggagggtatccaagaagccatatccaagatatatgacgcctcacactgccttgggtcacattctccaaaagcaagtattttatttgaatgtaagtattttatgatggaagtgctcccaggagaaacctagaagggagtggggaaagcaggaccaggaaggggaggaagccaagcagagtgagacctcagcagccctgtagagggtggcttcatcctgattccacagggagcactggatggaagttacacctcggaatttgtccccactctaagccaggggactcggctgtcctactcccactcctgtctgttatgagcctggggctgccctgggtaaggatggggaggaaattagcaggcacttcaaggtctcagagtatgtggcttgagaatggtcctcccatgttcatctcccaaaaagactggcaagtgtggttattggaagcaaaagcccactgaaggcggggaggggtatgcagaaatagcaaaagccacctgagggcatctgggcagggcaccagagtgtctgctggccacatggaatcccggaccctcaacattgatctgcaaagtaggtgcatctgtgctttgcagacaagggcatcaagttcagagaggttaagtaacttgcccccagtcacacagatagaaagaggtggtgagccttggaacccagggcctttagatttcccacgctgcctatgcatctcacagctgctagttaattaaaagagcgtcatcgtcaagggctaacaccacaccagcctcatccatgtgataatggctttgttccaagcaaccccggagccattttccttcttaggttgcaggcgaggaagcagaggtgcagagagtcacccagccagggccaagaaactgggatttgaatctgggtccatctgagtcccaatctcatccctaggttgaaatccattgccctgggccttctatctcgaggcaccatcccagcaattgcccagactgtgtcttgcccagacacattttgaaagactgtcttggaaaatgtgtggggcaaggtcaggtaaaatttttaggtttcttgggggtcacttaatgtcctttggcaagaaggtagaaaaatccagacctggatccaggcctctgggttgtgcagattgccgtggcctcctccctggcccaactccatagagagagggctgggttctgccagttctgttgctagtggtttctgaaagggtaatttggcaaacaatgctgagaagctggttgtggcaatacattaccatgtttaaagaaattatttttatcgctgtctgtattctgaggctctgaagaatgcagcaaccaaagacaggttgcgtagaggttctgtttgtgtgggccaagggtgaaggcacagatgaaggagtgtgtgtgtgtgtgtgtgtgtgtgtgtgtgtgtgtgtgtgttcgtgttcgaattcctgcctgcttctcagctggataaaatgtattatgcaggcactaggtctttccaccctaggaagtgttcataggagtttgaaatgctacatcttctttggagaaatgcctgtccaggatgttgcaggaggaactgacatcagtgaaaagatgggcgcatcaaaagacatttcagagcccatggtgggcctggacctaagggatacttgacaaggagtctgaggccttccccagatatcctcccatggctggcagggaaaggccttatcatatgtccagctgagggagagatggaagcatcccccatgtttgagaagaacacattacagagaactttgatttacatgactgacacaattttattttattttattttattttattttattttattttataactttttgagacagaatttcactcttgttgcaaggctggagtgcagcctggcaacctccacctcccgggttcaagcaattctcccacctcagcctcccaagtagctggaattacaggcgtgcaccaccaagcccagctaatttttgtatttttagtagagatggggtttcactatgttggccaggctgatctccaactcctgacctcaggtgatccacccacctcagcctcccaaagtgttgggattacaggtgtgagccaccacgcctggcctactgacacaaattttaagcttttcattaaagctaacattctcagaactttacacacccatgcaaccagcacccagataaagaaaacagaatatgaccagccccccagtaagtctcctcctgcctccttccagctgctcccctaccagggcaacccactcctgacttttaacaacagaggtcagctttgcctgcttttgtgcattctataaaaggaatcatacagactgatagaggttggatgtttatctcctccaaatctcatgctgaaatgtgatgcccagtgttggagttgaggcctagtgggaggtgtttgggtcgtgagggtggacccctcatggatagcttggtcccctccctgaggaaatgagtgagttctcattctattacttcatgtgagatctgattgttaaaaagagtctgggacctcccacctttctcttgctctctctcaccctgtgacacaccagctccatttcccttctgccatgactaaaagtatctgaggcctccccagaagcagatgctgttacctttcttcttgcacagcctgcagaaccatgaacgaaataaatgccttttctttataaattacccagcctcaggtattcctttacagcaacagaaaatggacgaatacacagacacattttgaaagggtaattggaaacagcccttgtaatgcagatcagaagtttactgtctgggatactcattatttaacggaatgttttggtaaagtcttttgtaattggattaactgtccctggacccagcctttgtgcatatgaagttctcttaaaacatctttcgggactagggagtcatttgggctactggaaatttacccacattgaaggcagagcagctgggaggaatcac

SEQ ID NO: 758 - DNA, 395718 bp, Homo sapiens
gtgctgcatattctagatgctgctgtcacaaaatgtgggaagttcagtcatcaatgaccccgcttaacaatgtggacaagaactcctgccagctctgagaggaggaggtagcgtgaatgaaaaacaagcttctgttctgtttggccacacggtgcattgatgagcctggggaagaaacggaaatctattcatactttgctgatgggagtataagttggtccaacatctttgggggtcaacctaaaagttacctaacaaaattctaaatgcataagccatttgatctaagaaattctatttctaggtatttgtcctatggaaaaaccccctacttgtgcacaaagatagataaatagatagaaacatacacacgcacacacacaaatcataggtactctgttaaacataacatgcagtagcaaaatagttcaacctacttagacgttctttaaaaggggaatgatttgtaaaaagataccgcatatctatggaatgtctaatatccagtatttttaaagaatagatttattcgtctagatatgaatcagtcaagatctgtaattaagtgaacaaagcaagatgctatggtgtatatgtacacttttaattttactattttattgaggtataattgatgtgcactgcactacacaatttaaaatagataacttgatggattcgagaggggtgcacactgtgacaccatcccatccccactatcacatgtccatcacctacaaaagtttctttgtgcatcttgggcatctctcccttccaccactgctcacatcctccagtgccactacctgtcaccaggcaaccagcgattttctgtcactatcaattaatttgcattttcaagaattttatataaatggaaccaatagttcattttcatagctaagtagtagtctattgtatagctataatacattctgatagctatctgggttgtttccactttttaaaatatatatatttagagggtacaagtgtaggcttcttacgtgcacacattccatagtggtgacatctgggctgtagtgctcccatcacctgaataatgaacattttacccaaaaggtggttttccagccctcaccagcctcccaccctctcatcttttggggtctccagagtctgtcactccatctgtatgaccatatgtacccactgtttagctctcacttataagtgagaacatgcagtattgcactccctccctcccaccctcccaccctcctgcccttcctctcttcctcctcctcatcttcttctttcttcttcctcttctctctctctttcttcttttctttgactgagtctcactctgtcacccagggtggagtgcagtggtgcaatctcggctcactgcaacctccgcctccctgcaacctctgcctcccggattcaagcgatcctctcgcctcagcttcctgagtagctgagattacaggtgcacaccaccacacccggatcatttttttattttttgtagggacggggttttgccatgttggccaggctggtcttgaactcctgaccttaagtgacctgcccgcctcatgactttctgtttctaaattagttcattgttcccacttttgagctattgcaaataaagcttccatgaacctctgagcacaagcgtttgtgtggatgcaagtttttgcttctcacggatagccctagacatagcatagctggtcacatattgggtatttatttaacttttaaggaaactaccaaattgtattctaaagtagtagcaacagtttatattcccatcagtagcatgcaaaattccagtggctcaacatcctcactaatacttagtatagtctgtctcttaaattctggcccttttaacgagcacatagcggcatctcgctgtggcttcacttgcatctccctgaccactaacgacgttgaacgtcttccatgcacttagtgcccatttgtgcagcttttaagtctttattcaaatattttaaaaatttaaaaaattttgcttgtcttattattgagttataagagatctttacctattctggatctacattattagatatatgatttgcaaatattttcttcccatctgtggtttgccttttcattttttaaatagtaccttttgaaaagcaagtttttcattttgatgaagtctaaccttttctttctttctttttttttttttttttctgagacagagtctcgctctgccgcccaggctggagtgcagtggtgtgatctcggttcactgcaacctccgcctcctgggttcacgccattctcctgcctcagcctcctcagtagatgggactacagacgcctgccaccacgcccagctaattttttgtatttttagtggagacggggttttgcagtgttagccaggatggtctcgatctcctgacctcatgatccgcccacctcagcctcccaaagtgctgggattacaggtgtgagccaccgcacccggccgaagtctaaccttttctttttttttgtattctacctaagaaagttttgcctaccctaaagattttctcctatgtgtttttaatggaaatttcataattttagattttacatgtaggtctatgcctttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggtctatgcctttttgagttagtttttgtggatggtatggggtaagggtcaatgtttacttttttgcccctatagatatccagttgatccagcaccatttgttacaaaaacttatctttccccattgaattgccatggcacatttgtcaaaaatcgattggccatatatgaatgggtttgtacctggactctgttatgtcaatctatatatctatttttttatttttatttttatttttgagatggagtcttgctctttcgcccaggcttgagggcagcggtgtgacctcggttcactgcaacctccacctcccagggtcaagtgattctcctgtctcagccttccgaatagctgggactacaggtgcgagccaccacgcccagctaatttttgtattttgttttgtatttttgttttaccatgttggccagactggtcttgaactcctgacctcaggtgatccacccgtcttggcctccggaagtgctgggattacaggcgtgagccaccgcacccagcctatacatctatttgtttgcctgtaccaaactgtcttggttcctgatgtaggggtgggttgcccctacacacctgtgggtgtttctcgtaaggtgggacgagagatttggaaaagaaaaagacacagagacaaagtgtagagaaagaaataaggggacccggggaaccagcgttcagcatatggaggatcccgccagcctctgagttcccttagtatttattgatcatccgtgggtgtttctcaaagagggggatgtgtcagggtcacaagacaattgtggggagagggtcagcagacaaacacgtgaacaaaggtcttggcatcatagacaatgtaaaggattaagtgctgtgcttttggatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccattcaactctgagttgacacagcacatgtttcagagagcacggggttgggggtaaggtcatagattaacagaatctcaaggcagaagaatttttcttagtacataacaaaatggagtctcctatgtctacttctttctacacagacacagtaacaatctgatctctcttgcttttccccacacctgagagtttataagctttgaaatcaggtagggtaatacctctagctttgttcttcttctttccttccttctccttcttctgctcctacttctccatctccttctccaggcaccagataccgcaacatcagattaatgagtggaatggacagaacaagctcctattctattttcttgctctagacgcccatttaatatattgtcctcagatagaggacatatcaaatactaaactaataatatagactacacttaatctttgccgaaaggctgagaaagaattgttcttctttaaaaaagaaaaaaaaaaaaaaaaaaaacacaactgtttctggccgggcacggtggctcacacctgtaatctcagcactttgggaggttcaggcgggcagatcacttgaggccaggagttcaaggccagcctagccaatgtggcaaaaccccgtctctactaaacatacaaaaattacctgagtgtggtgtcagacgcccgtaattccagctacttgggaggctgaggcaggagaatcatttgaacctgggaggcggaggttcctgtgagctgagattatgtcactgcactccagcctgggcaacagagaaagactccatctcaaaaataaataaataaacaaacaatacaaaataaaataaaataaaaaattgtaaccaagcgcagtggctcatgcctttaatcccagcactttgggaggctgaggtgggtggatcacctgatgtcaggagttcaagaacagcctggccaacatggcaaaaccctgtttctactaacaatacaaaaattagccaggcgtggtggcaggcacctgttatcccagctactggggaggctgaggtgggagaatcccttgaacccaggaggcacaggttgcagtgagctgggatcacgccactgcactccagcctgggcgacaaagcaagactccatctcaaaaaataaaagcttctctaggccctccatatttccatataactcttagtatcacgttgtcaatttatgtaaaaaagccttgaattttgtatggagttgtgttaactctatagatcaatttgggaaaatttgacatcttaacaattgctattgattgaatgtctttgcccgcctcccagatttacatgttgaaacctgatacccagtgtggtggtatttggacaaggggactttgggagatgataaggccatgaggatagatcccacataaatgggattcgtgtccttacaacagagaccttagagagctgcctccctccctctgccatgtgaggacacaataagaagacagctgtctatgaacaggaaagccagtcctcaccagataccaaatctgctgcctcaatcttacacttaccagcctccagaacatgagaaataaatgtttgctgtttaagccacctatattgctgtagcagcccaaacagattaagacaatcatactgaatcttccaattcatgagatatatttttgccaattcagaaatgtggtatattaattgaaatctttaatttctctcagcaacattttgtagttttcagcattaaaaattttaacatcttttgttaagttttttcctaagcattccatgttctttagcactattgtaaattaatttttaataattatttgatgccgttacataatacaaatgattttatttatttatttttttgtagagacagggctttgccacattgttcaggctggtcttaaacttgtgagctcaggcattcttcctgcctctgtctcccaaagttctgggattacaggcatgagccacggctcccaaccaagaatacaaatcattttaatatagcaatcttgtatcccgtgaccctgacaaattcatttattcattctagaagtttttgtaaatttcttgggctattatacaggagcaatcataaactttgcaaataaagataactgtacttatttcttttttaaaaaaattttactttaagttctgggacacatgtgcagagcgtgcaggtgtgttacataggtagacacgtgccatggtggtttgctgcacctaccaacccatcatcgaggttttaagccctgcatgcatgaggtatttgtcctaatgctctccttccccttgcccccaacccccgacaggccccagtgtgtgatgttcccctccttgtgtccatattgttcaactcccacttaggagtgagaacacgcagtgtttggttttctgctcctgtgttagtttgctgagaatgatgggttccagcttcacccatgtccctgcaaaggacatgaacccattctttttcatggctgcgtttaattaattaattaattaattattgagacagagtctccctttgtcacccaggctggagtgcagtggcacaatcttggctcactgcaacctctgcctcctgtgttccagtgattctgctgcctcagcctcctgagtagctgggattacaggtgcccaccaccaagcctggctaatttttgtaattttagtagagacggggtttcaccgtgttggccgggctagtctcaaactcctgacttcaatgatccccccgccttggcctcccaaagtgctgggattacaggcgtgagccacggcacctggtccaattctaactgtttctgatcattatagcttttctttctttttctaatcttatcacattggctagggctttcccaacaatgttgaaaaggtggtgagaggaaagtggagcaagatgctcaagtagggccctccagcaatcaccccccaccccacccaacccccggccccacccacccccaccccacccctgcccaggaccactaaaccgaaaactctcaagttgagaaaaaacctgcataagaaccgaaaatcagatgaacaactgcagtatctggttttcatatcatctcaagaaaagcactgaagaggacaggaaagacgatcttgaaatgctaacatcacccatctcctaccccatggcagcagtcccacggcatggagagagaatccgtgagctgggggaggtagagcacagtgatgatgggactttgcacggcacggagagagaatccgtgtgctgggggaggcagagcacagtgatgatgggactttgcatggcagggagagagaatccgtgtgctgggggaggtagagcacagtgatgatgggactttgcatggcagggagagagaatccgtgtgctgggggaggtagagcacagtgatgatgggactttgcacggcagggagagagaatccgtgagctgggagaggcagagcacagtgatgataggactttgcattgccactcggtgctgcccagtcacagtggaaaacaacacagggcagcactcacagacacagcatttaaaccagccctagcaaagacaaatcctcaatctcagtggtgtgaacctgaattctagcaagccacgcactgctggctaaagagctctgggatcctaaataaacttgaaaggcagcctaggccacagggactgcaattcctggaaataccctggagccagtggacttggggtgcacatgacctagtgagacaccagcgggggcagcccagggagtgcttgtgtcaaccctcacccacccccaggctgcgcagctcacagcactgggagagactccctccttctactggatgagaggagggaggaggataaagaggactttgtcttgccacttgggtaccagctcagccacagtaaaataactcaccaagcagagtcctgaagctcccctgttctaggccccagctactggacaacatttctaggcacatactgggccaaaaggaaacctgctgcctggaaggaaagggtctgtcctggcagccttcttcacctcccgactaaatagcccttgggccttaaataaatatcagcagtagccaggcaggcagcactcaccacaggccttgggggagactcagagccttactggctttaagtgtgacccagcacatctccagctgtgatggccacagaaagaggctccttctccttgagaaaaagggagagaagagtaaagaggactttgtcttgcactggaggtaccagctcagccatagtaaataaagcagcaagcagattcctgaagtcccagattcccagccttagttcctggatggcatttctgcacctgctctgggctggaagggaatctgccgccctgaaaagaaagacacaagcctggctgcatttgccacctgctgactaaagagcccctggggcttgaagaaacatcagcggtcaccaagcagttcttgccacgggcctggggtggtagcggccatggggagaagactcctgcttggggaaaggagagggaagagtgaaaacgacgctgtgtttaactcgggggtcagcacacccacagtaaaatcaagcaccaagtagattccaaaaattcccaattctgggccctagctcccggaaagcatttcgagattcaccctgatttctagacccaccctgggccagaagggaacctgccaccctgaaaggaacaagacaagcctggctgcattcacctcctgctcaccaaagagtacttgggccctaaacatcagtgggagtgaagccatagttgccgcaggctgtgggagagacccagcgctgggctggcttcaggtctgacccagcatggtcctgaggagagaggtcatttctcttactgtctcctgtctctgaagagaaggaggaagtaaaagctgaaaaacaacaggaatgaagtcagtggcaagaccagccggcgcactgatgaccaggcctgaggttaaagattaacccccgactctaaccagatgtgctctctatagatctcaatctatcacaaccctttcatgtggaccccttagagttgtaagcccttaaaagggccaggaactctttcttctaggagcttcgttcttgagatgcaagtctgccgacgctcccggccgaataaagcctcttccttctttaacccggtgtctgaggggttttgtctgtagctcatcctgctacagtcccagtgctggtggccacaggagtgcttgtgtcgcccctcccctaactccagacagctcagcatggagagaaagactccatttgtttggggtaaagtgaaggaaaagaacaagaggctctgcctggtaatccagggaattctcccagatcttacttaagaccaccaaggtggtccctctatgagtctgcaagagtcatagtgttactgggcttgaggtgcctctaatgcagatgtgactgcagtgacaaaagacttaggtcacaaccctcagttccctttgaataccgggaaagctttctcaagaaggacgggaggccgggtgcggtggctcatgcctgtaatcccagcactttgggaggctgaggtgggtggatcacctgaagtcgggagttcgagaccagcctgaccaacatggagaaaccccatctctactaaaaatacaaaataagccaggtgtggtggtgcatgcctgtaatcccagctactcaggaggctgaggcaggagaaccacttgaacccgggaggtggaggttgcagtgagctgagattgcaccactgcactccagcctgggcaacaagagtggaactccgtcaaaaaagaataagaataaggaggaggaggaagaaagaggaaggagaaggagaaggagaagaagaagaagaagaagaagaagaagaggaaaaagagaagaagaagaagcagctcagacttggtggctcatgcctataattccagcactttgggaagccgaggagggaggatcacttgaatccatgagatcaagaccagcctgagcagcacactgagaccctgtgtctacaaaaaatacaaaaatcagctggacatggtggcatgtgcctgtagtcccagctacgcgggaggctgaggtgagaggatcgcttgagcccaggaggctgaggctgcaatgagccatcatcatgccattgcactccagcctgagtggcagagtgggactctgtctcagaaaaaagaaacaaacaaagacagatgggtacacacaagcacagactgtggagattacaataaataactaattctttaatgcccaggcattgaccaacatccacaagcatcaagagcatccaggaaaacatgacctcacaagatgaactaaagaaggcaggagtgaccaatctcagagtgatggacatgtgaactttcagagaaaacgctcaaaatggctgtttagaggaagctcagggaaactcaagacaacacagagaaggaattcagaatcgtatcaaatatatttcacaaagagattgaaataattttttaaaaccgagcagaaattctcgacctgaaaaatatcattgacatactgaagaatgcatgagatctcttaccagcagaacagatcaagcagaagaaagaattagtgaggttgaagacaggctatttgaaaacacacagtcagagaagacaaaagaaaaaagaataaaaaactataaagcaagaaataaaataaaaacaatgaagcacacctacaagatctagaaaatagcctcaaaagaacaaatctaagcattagaggaggtagagagagagatcagcatagaaaatctgttcaaagagatagtaacagcttcccaaacctagagaactatatcaatattcaaatgcaagaagattgtagaacaccaagtagatttaaaccaaaggtatttaataatcaaactcccaaaagtcaaggatgaagaaaaaattctgaaggcagaaggagaaaagaaacaaataacatataaggagctcccgtatatcttggagcagacttttcagtggaaacattataagccaggagagaggggcatggcatatttaaagaactgaaggaaaaaaaactttcatcccagaatagtatatccagggaaaatattctgaggtcaggagtttcagaccagcctggccaacatggtgaaaacccatcactagtaaaaatacaaaaattagtcgggtgtggtggcacccatctgtaatcccagctactcaggaggctgaggcaggagaatcacttgacccagaaggtggaggttgcagtgagctgagatcacgccactgcactccagcctgggtgacagagtgagactctgtctcaaaaacataataataggaataataaaggaaaagtgcaaaaattcaaacaacttaacagaaactgggcaaaagagctgaaccggccctccacagaagaggaaatgtggaggaacggctaatgaaaacatgaagaggggctcagcctaacgggggagatatcacgtgacactcaccagacgggcaaaaatctcacaacccaatccatgccagcgttggggagaatggtgagaagcaggaacaccaggcactgctaacgcttgtgaagtatatttctgctatgcttgtatatgaaagagtgtgtgttgtgggttatgaggaaaattacatttcttacctgggatgaaattttaaaacttgaaagctactgaccagaagaaacttgcgcttgtgtacaaaagaaatgcccaagaacgttcccaacaaaacacagtcctaagggccccaacctggccaaacactcatccacgggaagatgaagacatttcccatgctcccctcagacgacgggagaccatgcagcaatgaaaatgagccatgtcagtgtgggtgggtctcagggagagaatggaggacaaaaatagacacagagcaggtgctcagagccatgcagtgtaggagcagccatgcaggagaattccctcacgtcaaagttcaaaactacagccgaggcaacagagcaagaccctgcctcagaaagaaaacagaaagttcaaaaactaaatggcttattttttagggatgtacacacacggtgaaagaaatgtactatgaaggaaagtgtgcaaataataaagactaaagcaagaagtgattccctccgtaggagaagggaagggactgggactcaggcagggcctccagggagcatccaaagttatgtctcttcagattctactccctaaacttggtggaggtcctctgtgtccaatgtgtcaatattctttataccttacccatactgtaaaaacgctttatttctattcaatatttagaagacagttataaacaggatgcattcaatagcaaggtggcagatgaacatcaggaaggaacatccatgagcttccatccacggaacctcaccatggatacgcttgtgatcaagggcctggtctcccctcaagacacggtcacagatcagagggcacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcactctgtcggtctcactctctcacacgcttccccggctcccttcgttcccccccaccccacttggcctgcgtgctggagggtgtgcgagggagtgggaggacgtcggggggtggggggaggcgttccggtccccaagagacccgcggagggaggcggaggctgtgagggactccgggaagccatggacgtcgacaggctccaggaggcgctggaagattttgagaagaggcaaaaaagaaagtctgtcctgtcctggatcagttccttttgtcatgtagccaagactggagaaacagattcagtggtcccaatttaaaggctattttattttcaaactggagaaagtgatggatgatttcagaacttcagctcctgcgccaagaggtcctcccaaccctaaagtcgaatatattccctttgatgaaacaaagggaagaatactgaaaactgtcactggatttaaccgtatcccttttactattcagcgattatgtgaattgttaacagatccaaggagaaactatacaggaacagacaaatttctcagaggagtagaaaagaacgtgatggttgttagctgtgtttatccttcttcagagaaaaacaattccaatagtttaaatcgaatgaatggtgtgatgtttcctggaaatgcaccaagctatactgagaggtctaatataaatgggcctgggacacccaggccacgtaatcgaccaaaggtttctctgtcagccccatgacaacaaatgggtggcctgagagcacagacagcaaagaggcaaatttgcagcaaaatgaagagaaaactcacagtgactcttcgacatctgaatcagaagtttcctcagtgagccctttgagaaataaacatccagatgaagatgctgtggaagctgaggggtatgaggtaaaaagactcaggtttgacaaaaaggcgaagtcggagaaacagccagtcaagagacttgcagcgaaatttcttcagttatggtagaagaaacagaagcatcaccttcatctcatgataaagacaaagaaagctgtggtacccggcagcgtgttcagaagaggatgaagaagatgaagaggaagaagaagggactgagagaccatctgtaaaagggaggagtaaggagatcctcaaattcttgcattcattgttttcgtgaaagaactgtacgtcatggaactccttgtaatgccgacgctgggcttttctcccacctgtatgcagttgctgctgaatttcaggggatgtgatttgaactacagagcatcagaattcatgaaacttaactgtggaggtattttgaaaacaaaatttaagtacaacaacatttgcttagttttagagtcttttatgacatcaagagaaatgatcccagaaagaaataaacaagaaaaagaatctgatgatgcctcaactgtgaatgaagagacttctgaggaaaataatgaaatggaggaatctgatgtgtctcaagctgagaaagatttactacattctgaaggtagtgaaaacgaaggccctgaaagtagtggttcttctgactgccgtgaaacagaagaattagtaggatccaattccagtaaaactggagagattctttcagaatcatccatggaaaatgatgacgaagccacagaagtcaccgatgaaccactggaacaagactatttagaaacatatacatgcagtattttacacacagttctggttttaacactgtgtaaaacttttatgtaaaaacgtgcacctttagttttacaagaaaagcaggttgtaaaataaagtactttatggataattcctgaaagagttgtccatgtaagaactgtgaatatcagctcctctgggtcctgcttaccttaccgctgatttctctttctttctttctttctttttttggtctgggcaaatcagtggtttgtatatagaagttttttttttaatttaggactgaagtctttaaactggaaagtaattataattttgaacagttttttgagattatcacatttagtttatacatatgcaagaagctttttgtcttgtgtctttctgatagctctagcagttttcatattttggtcatagtttcaacattttaacatgtgaataatagagtttcatgctggtttccagattgtattgttcggctacatacaatagaaccttaagttttatatatatgtatatattattctaagggggaaaatgttatatttttctgttggtataagagataaatacagtggatactttttctattggtaatgattgaattcacctctttcagaagacattttctttctcttctgagtaactgaaataaaatctggcctttgtgaaaccctggaaataccacaaccctcaactagaaacaccaataccagctcctccgcgagtttccagctccacaacctaagacatcagaggcagcattggttcctcacgtagagtccagctccgggaccctcatatttgaaccgcagggccatctcatccctggatctccagctgcaccacactcaaattagaacaacatcagttcctccccaggtctccacctgcacagccctcgaaagggaacatcagctcctccccgggtctccagctgtaggtccctaaaactagaacatcagctcccgcctgggtcgccagcagcaccaccctcaaactggaacatcagatccccatgggtctccagctgcagggccctcaaactggaacatcagctcccccaccagatctccagctgcacggacctcaaactggaacatcagctccccgccgggtctccaggtgcactgcctgcaaactggaacatgagctccctgccgggtccccagctgcatggccctcaaactggaacatcagctccccaccagatcgccagctgcacgaccctcaaactggaatatcagctccaccccggggctccaggtgcacagccctcaacttgcaacatcagctccccaccgggtctccagctgcacggctctcaaacaggaacatctgctccccacagggtctccagctgcacggctctcaaacaggaacatcagctccccacagggtctccagctgcacggtcctcaacctgcaacactggctccccaccaggtctccagatgcacggccctcaaactgcaacatcagttccccccgggtctccagctacaccgcgtcaacctggaacatcagctccccgccgggtctccagctccacggccctcaaactgcaacactggctcctcaccgggtctccagatgcacggccctcaaactggaacatcaactccccaccgggtatacagctgcatggccttaaactggaacattagctccccgcccaggtctccagatgcacggccctcaaactggaacatcagttccccgccaggtctccagctgcacggccctcaaactggaacatcagcttcccgccgggtctccaggtgcacggccctcaaactgcaacatcagctccctgctgggtatccagctgcacagccctcaaactggaacatcagctccccgccaggtctccaggtgcacggccctcaaattggaacatcagctccccgctaggtctccaggagcacgggcctcaaactggaacatcagctccctgccaggtcaccagctgcatggccctcaaactggaacatcacctccccgccaggtctccagctgcatggccctcaaattgcaacatcagctcccatcagagtctccagctgcatggccatcaaactggaacatcagctcccccgcgggtctccagctgcacagacctcaaacttggacatcagctccccgccgggtcatcaactgcacggccctcaaactggaacatcagctccacccttgggtctccagcagcacggccctacaactggaccatcagcttccccccgggtctccagctgcacagccctacaaccggaacatcagctccctgccgggtctccagctgcacagccctcaaactggaacatcagatccccactgggttcaaactattccagtttgagggccgtgcagctggagacccggcggggagctgatgttccagtctgagggccgtgcagctggagacctggtggggagctgaagttccagtctgagggccatgcagctggatacccggtggggagctgaagttccagtttgagggccgtgaagctggagacccggtggggagctgaagttccagtttgagggccgtgcagctggagacccggcggggagctgatgttccagtctgagggccgtgccgctggatacccggtggggagctgaagttccagtctgagggccgtgcagctggatacccggtggggagctgaagttccagtttgagggccgtgaagctggagacccggtggggagctgaagttccagtttgagggccgtgaagctggagacccggtggggagctgatgttccagtttgagggccgcgcagctggagactcgggggtagccgatgttgcagtttgagggccgtgcagctggagacccgggtgggaaccaatgttccagtttgggagccatgcagctggaggcactgcggggagcagatgttccagtttgatgttcctccctgggtctccaggtgcacggccatcaaactggaacatcagctccccggccctcaaaccagaacatcagctccccgccggatctccacctgcacagccgtcaacatcagctcctccccgagtcctcagctgcacgaccctcaagttagaacatcagcttctccccaagtcttcagctgcgtgaccctcaatctagaacatcagttcctctccgggtctgcagctgcaagaccctcaatctagaacgtcagctcctccctgagtctccagctgaaagaccctcaaaacaaacaacatcagctcctccccgagtcttcagctgcacgacgctcaatctacaacatcagctcctgtctggttctccagctgcacgaccctcaaactacaacctcagctcttccccgagtcttctgctgtatgaccctcatctagaacataagctcctctctgggtgtccacctgtagggaactcaaattagaacgtcagctcctcccagagtcttcagctgcatgaccctcaatctttaacatcagctcctctccgggtctgcagctccatgaccctaaaaatacatcagcagctcctccctgaatcttcagctgtacgaccctcaaactacaacatcagctcctgtctgcatctctagctgcacggccctcaaactagaatatcagctcctccccgagtcttcacctgcacgaccctcaaactagaacatcagctcctgtacagatttccaactgtagggccctcaaactagaacatcagctcctccccaagtcagcagctgcaagaccctcaaattaccaccttagctcctcctggagtcttcagctgcacgaccctcaatctcgaagatcagatactctccgggtcttcagctgtagggccctcaaactataacatcagctcctctctgagtattcagctgcacgaccctcaatctcgaacatcaactcctcttcaggtgtgcagctgtagggccctcaatctagaacatcagctcctccctgagccttctgctgcatgaccctcaaactagaatctcagctcctcccgagtcttcagctgcatgaccctcaaactagaacctcagctcctccctgagtcttcagctgcatgacccttaatctagaacatcagctcctccccgagtcttcagctgcatgaccctcaatctagaacatcagctcctctccaggtttgcagctgcaagaccctcaaactagaacatcagctcctctccaggtctgcagctgcaagaccctcaaactagaacatcagttctcctacagttctgcagctgcaagaccctccatgtagaacatcagctcctcaccgagtcttcacctgcatgaccctcaaactagaacatcagctcctctccacgtctccagctgcatgaccctcaaagtagaacatcagctcctctccggctctgcagctccaagatcctcaaactagaacatcagctcctctccaggtctgcagctgcaagaccatcaatctagaacatcagctcctctccaagtgtgcagctgcacgagtctcaatctagaacattggctcctctccaggtgtacagctgcacgactctcaatctagaacatcagctcctctccaggtctgcagctacaagaacctcaaactagaacatcagctcctctccaggtctccagctgcatgaccctcaaactagaacatcagctcctctccgggtctgcagctccacgaccctcaatctagaacatcagctcctccccgggtcttcagctgcacgaccctcaaactagaacatcagctcctccctgggtctgcagctggaagatccactaactagaacatcaaatcctgtctgggtctccagctccatgaccctcaatcaagattatcagctcctccctgagtccccagctgaaagaccctcaacgcgaacaacatcagctcctcctgaagtcctcaactgcatgaccctcaaactacaacatcagctcctccccgagtcttcagctgcatgaccctctatctagaacatcagctcctctccaggtctgcagctgcaagaacctaaaattagaacatcagctcctctctgggtctgcagctggaagatccactagctagaacatcagctcctgtccgggtctccagctccgtgaacctcaatcaagattgtcagctcctccctgagtctccagctgaaagaccctcaacgcgaacaacatcagctcctcccgaagtcctcaactgcatgaccctccaactacaacatcagctccaccccgagtcttcagctgcaggaccctcaatctagaacatcagctcctctacaggtctgcagctgcacgaccctcaatctagaacatcagctcctctacaggtctgcagttgcaagaccctcaaatgagaacatcagctcctctccggatctgcagctgctagacactcaaactagaacatcaacttctgtccaggtctccagttccgtgaccctaaatctagaacatcagctcctccctgagtctccaactgaaagaccctcaatgcgaacaactaaagctcctccccaagtcttcagctgcacgaccctcaatctagaacatcagctcctctacaggtctgcagctgcaagatcctcaaactagaacatcagctcctccccgagtcttcagctgcatgaccctcaatctagaacatcagctcctctccgggtctgcagctgcaagaacctaaaactagaacattaccttctctccagggctccagttctatgaccctaattctagaacatcagctcctccctgagtctccaactgaaagaccctcaacgcgaacaacatcagctcctccccaagtcttcagctgcaagaccctcaaactagaacatcagctcctctacaggtcttcagctgcacgaccctcaaactagaacatcagctcctccccgggtctgcaggtgcaagaccctcaatctagaacatcagctcctctccgggtctgcagctgggagaccctcaatctagaacatcagctcctctccgggtctgcagctgcatgaccctcaatctagaacatcagctcctctccaggtctgcacctgggagaccctcaaactagaacatcagctcctccccgggtctgcaggtgcacgaacctcaatctagaacatcagctcctctccgggtctgcagctgcatgacactcaatctagaacatcagctcctccccgagtctgcaggtgcacgaccctcaatctagaacatcagctcctctccgggtctgcagctgcatgaccctcaatctagaacatcagcacctctccgggtctgcagctgcatgaccctcaatctagaacatcagctcctctccgggtctgcagctgcatgaccctcaatctagaacatcagctcctctccaggtctgcagctgggagaccctcaaactagaacatcagctcctccccgggtctgcaggtgcacgaccctcaatctagaacatcagctcctctccaggtctgcagctgcacgaccctcaatctagaacatcagctcctctccaggtctgcagctgcatgacactcaaactacaacatcagctcctctccgggtctgcagctgcatgacactcaaactagaacatcagctcctccccggatctgcagctgcaggaccctcaaggtagaatatcagctcttccccgagctaaaacacctctcccacctggatctccagctccacgagtctcacagaacagccacactggctccttcattgtcttcagctccacaacctaagacatcagtgggagcaccggctcctccctggacctccagctcaacgaatctcatagacttaaaaggcagcacctgctcctccccaaggctccatctccaccaccctcagatttgaacagcggtagcaccacctcctctccaggtcttcagccccacgtccctccctgaacaatcccttctcatgaaattcagcagtcaagaaatctgcagcggaagtaaatgaataaatgttttgttttcaaatcgatacctcttttatgttcatgagttaacttttctactttccattagccttgcaatctacttatgtccaatgtgaaacagaaacacaccatttgaaatcacgtttaaaaacttagtagtttttcaataaaatcatcacacagctgtagacacgatcttatttctctctgcctgtgcagaagtcttatgaaaattcaaactatgaatttactttgttgagattcccagaatacacattaatcccaactgttactcccctccttaaaatcttttaacacattcccatcacctgagcataaatgccagctcccatccacagcccaaagtgcccagcacggccctgccctctgccctggtctatggtctcccctcttaaatgccagcaccatccacagcccacagtgcccagcacggccctgccctctgccctgccctctgctgtggcctaaggtctctcccctgtgccattcccttcctgacggacaggcctctgtccgttcctcaaaccacacaggctcaggcctgactccaggcctttgcacttctgtgccctctgcctagggtgcctttcccgggctctgcatcctcctctcaacccgctgagctccagcctgctggtcgcccctcaggtggatgaacacacggtgtcctctcgccccaccagcttttgcacaggctcttctctgtgccagacacacaccctctctatcggggtttactctctaaataccattcatccttggagtctccactgaaatatcgctccctgcccacccccctcacttggacttaaccttggttaggttgccaacccccgtctcctgactccgggaagctagatgctctcctagcactcggaacttgcccatcgccacatttgcacacccctggttactgggttaggttggcgcacaagtcatcgcgggttttgccattactattaatgaacggcagcaatggctcctccccgtttcttttttttttttttttttgccattacttttaatgactgctgcaccaacctattagaatcatttatatttatccatccatcatgtgtcttcccctctagaaaggaagctccatgagaatagaggccaaatctactcaaatcactccaccttcccagcacattgtttgtcaataatcatttaccaactgactgatagagaaatgccttccctgttgctgggatgaggcacatgacacgcccctttgaaagtcaattccatggacagttagcatttgctcttcactactgcacctgtggcatggctgggcttaggctgatctagtctggccttgactccaggctaaggatgggaaccatgcctgctccacacgcctctcatcccacagccagagccgccgttccctggagcacgcacatctcgtggggaaaatcaagagccttagagggcaggcctggcagtgcccacagattccaggcttctgcttgtaccgtgtctgtgaaaatctcattggcagaagcaagtcacccagccacgagcaacacctatgggatggataagtccatccaccctccctcgggccctggcaaggttgtggctatgtcatactcttacggggggagtgaaaaattgatgcgcaacattaaatcacccaggcaagaaatgtcagcctctgtcctcgcgctggaatcattcttcaccaccgggtttgcctgaattccctttgcaatggtgtctgcaggtttagcccaatgctggtccccgtggaggacagagaagcctcaatgggcctccgtctgttgggaagaacaagatattagcttggcgcaaaaccaccgcaagccccagggggcccttgcgccatgagacaggagaggggcagagaactgtgggagctcaggaaagctcacatccccagcccctcccgtgcatccccagcccctccactgtgaccccagcaccaaccctctcccctgcttgccccatctctgctttctttttttcattttctttctttccttgtttttgagacagggtctggctgtgtcactcaggctggagtgcaatggcacgatctcagcttactgcaaccttcacctcctgggctgaagcaattctccctcctcagcctccccagtggctgggactacaggtgcacgccaccatacccagctaattttttttttttttggtagagacaggatttgccatgttgcccaggctggtctcaaattcctgagctcaagtaatcctcccacctcagcctcgcaaagtgctgggattacaggcatgagccaccgagtccaacctactttatttttctctacagtacttggaaccttctaatgtactaaggacacgtgtattttctttcttttttgtcttccctagaacaggagcttaatgtgggcaggtatttttgttgatctcatttatcaccctctccccagttcctggaacagggtctggcacatgaatggtgtgttctaaataaatatttttaatagataaaaaaatgaaatatcctacaagagaaagctatatctggaactcacccatcaacagaacctaaaggacaaagacctttagcctgtctctgcctctgaacacacccaaccccggaggagccagcagaggaaaaagaggacaaaggcggggaagggagcaggtggtgcccaccaagtaaggaaccctgaggcttaggcggaacctgagctggagaagggactcatctaggaactgggtatgagattaaagtttagattggtctggcctggattttgtaacacctaaacaagagttattctattctttttttgtgtttttttttttgagatggagtctcactgtcccccaggctggagtgcagtggcgctatctcagctcactgcaacctctgcctcccaggttcaagtgattctcacgcctcagcctcccgagtagctgggattacaggcgcacaacaccattcccggctaattttgtatttttagtagagatagagtttcaccatgttggccccctggctcacgcctgtaatcccagcactttgggaggccgaggtgggcggatcatgaggtcaggagattgagaccatcctggctaacacagtgaaaccccatctctattaaaaatacaaaaaattagctgggcgtggtggcaggtgcctgtagtgccagctactcaggaggctgaggcaggagaatcgcttgaactccagatgcagaggttgcagtgagccaagatcaatgccattgcactccagcctgggtgacagggcgagcctccatctcaaaaacaaacaaacaaacaaacaaaaaaccttcaaacgaatctaagaattattattttttaaagtacaactttaaaaatgccccttacaaatacaacagtgttatattaaggcaaacccacttcagaagcacaaagttaatttcttataattccaataaatatgtgaatgttaaaaaaacccaaacacccgaaaagggatcaaactcaagatagtttgtaacattttattgcaaaaagaagggcagagaacagtcttcttcatacctgttcaccacagtaatttttagcggctctcctgtgcaaagaagtctcatcaatgaaccagcgtacgggccacaaataccttctcagtgcggtttcacctacaatacaagcactcagaagcacaaatttaactgaagtgagaaaccaggccattttgtagcttcagtttttctaccagtaatatattaatttcttgaaatagcctaataatttagttctactatcaaaacagaagcccaatctgggagaacaattattatacaagtcaaactaatttcaatcatattagtataggaattcatattagtataggctaataattcatattagtagaggcgggaggatcgcttgagcctaggagtttgagaccagcctgggcaagacagtgagactccatctctaattcttttttttaaataaagaaattcagagaggagaaggaagcggactgatatgtgtctatccaaggacaaattttgtgtgcctgtacatacaacacaactatgaaccttccttcacgcagctcacaatctagtagcgagaagaaactacgaaaacatgagcccccacggtgaggaaaaaggcgcatatcagagaaaagaaaaatgctgcgatgatccaatggcaggagcagcgcgcatccactttctttgtttttttgagatggggtttcgctctgtctcccaggctggagtgccgtggcttgatctcagctcaatgcagcctcaacctcccaggctgaagtgatcttcccatctcagcctcccaagtagctggaactacaggcgtgcaccactacacgtttactttttgtagaaacagggtctcacaatgttgccaaggctggcatcctgaagggcgggtggggcttcatcctacagagatgaaaggcagaagctcagagcccaaagcaaaggggtggaggacaagggcatcttcagaacagagtggctcggctgagacatccagtaggatgccaccaggcagaggtgtggtggaaaaacacagggccacagggtgaatggtcacatgtcaggagcaaaccaccacagaacatgacagaaacacggtgtactaaatcaggcttcaaatcgcagccctgcaacttcagagctaccacaggtaacccagaaagggagcatggacagcaccacccactgcctgaggctatgagatggaccagaaacctgtgcttactaccagcctgccttattccagaaggaattcaggaaacacaaagacactcacagtacagcaaaataaagtaaatgtgaatcatgttggctgaggagaaacggaagagtctaagactatgtcataaagtttacctctactctaaactctcattactggcgagccaccaatctgactttaagttctctagcagctaaactgaagaggaaaatgtaatcaggtaaaggtttataagatgcaaacaaaacaggacagccaccacagttgctgagaacacgcgcagctccagctccaggagaaacagggtggccatctcctggggctgccccgcagcaggtgtgtcagccccaaagccagcgtctctcagggtaaacggtgactacgggcttcatggggccacatgcctccaacacaagctgaggaaatctcccagggcaattcaaggaacagggtctcacaatgttgcccaggctggtctcaaacgatccccctgcctcggcctcccaaggtgttgggaggtcagacgtgagccactgcatctggccccgcatgcactttatagaggagggctttgcatcctgtacggcgggtggggcttcatcctgcagagatgaaaggcagaggaagctcagagcccaaggtaaaggggggcgcctaacaaaagcgactccattgggaccacggtgagagggtccccatacacagcttgggttaagccagacactgatttcaaagtatctcaggaatggtggactcagcacctgtcaggcaattctctctctcaagcaggctcctggtagatatttagtagcagctgaaatcaagattatgttctgactgacacttgctgagggttaaagagctatatacgctttgaggaccagctgaacttgggcaggactaacaccctctggtgaaaatacgggaacccaaacacacgagtcagagcaggaggtgtctcccccacccccaaacaataacgctgaccttggatttgggttaagtgcctagcccaggggtgtgagtgttcaggaagtggaaaccatcatcaccatcatcaggtaatggaaaaccatcaaagctttgagctggcttgttagccaagaatagtagtagtgtattagctactactaatactcacagctgacaattactgagcacttgctccgtgccaggaatcacgggaagcacctcacatgcatttcctcaattctccctcccagtaatggcgaggacacaaaactggtagagccaggactggaatccaggcaggccccaaagcactccagtggagcctgccaaggtgtgcaggctaccatgctaatgaggtccagtatttgaccaccactcctagttgagcaagtttaacagaaaacctaaaactaaacttaaaatctaaaaatttgagcaaatgcataaaaagcaggctcttaaaatggatcataaatcttgcatcacttgctggaaaaccactcaaaatacacatctctgagacatggcctctgaggagggcactccatgtggctcgtatcaccctggtgacaaaccacgtgaacctgggtggtcacctgaccatattgaacagacgatgcacagagccatttgcatccactgtggtcaacatttaggaagttttaagctaagatttgccaaattgtagcctactggattccggttctcttgacatctctttctagtagccatgtcttgcacttcccgagtataaacgaactgagatgcaaataaaaaaaaggaggatttaagaataatgaaaagagaaaaatcaagaaagcacaatcactagtgtagagataacagaatttctgaattccctgaaaacaatctatataaatgcatgtgaaataatacaccagcatctgtggcccatacgtcacatattaggaactgataacataaggtaaacatgttactctgaaaacacaaatcctcacaaatcattaggcagtaagactgaatccagcacctcccccacccacagcgcagtgaggcagtgtctagcagccgtagtgctccccgcgccccagttcagtctctggcaacatcagatacttcccactaataacgaggagcctttcaacattttcacatctcaaaactgaccccttttctagcttaaatggcacggatctggaaaggcaaactatactcagaatcagaaaagatgactgcccctgagggattacagaaaaagcagcagtcaggtgttcaatgaagtaaaatgtatccaatgatagctcaggggagggggatcaattgagctgaaactggcaagaacgtaactccagggagctcacaacacgcaaggacccggatttcccgctgcctgaacgcccactattcgcacactgataagaacgcctccccataactcccctgccagcgcctccaacacccccaatcctttccccaggaacccagtcccagtttctgcagttcctgtaacagccacgttcccacacaagtgctgcctgagctccccaagccctccaacaatcaccccccagtgccctcgaaggtctattcagagaagtcaccaagatgcagtcacccaggaaattcaaggacccccaacttaccaaaaggctttcggctggacagagctaaccttcctattcccctcctaaacctacaacctagttttcatttctcaagaagcctttccctgtgctcacgcacgccgttgttagctggctcggtgaggcactccaagcagtaacagcggtagccacagaataaaccagaagcatctccaccatgaagcagtaataataatttgccctaatgattcctttgtccttggaaaatcaacttcagaaagaaagttatccactgtgagcagggcaggctcgcggcttcttggtccggagacccaggtcccactggcccactcacccttggagagagcttgccgaagctgggtgtccgatatcactccactcctctctatcaaccctataacatcaagaagaccaaacaagctggcgatcgaaagttcaggaaaagcaaaacaaacgtctcctgtcaaccctgcaccgactctggaaggctccctcctggaacctccgcctctccggtcccgctgacgagtacagcggaatcaaggaagtgccccaggagccacgtccaagtgtgttcttcccctaagaggccaatcatctttctctctcttttcccacctcaatccttcccttccttcccctcctgacctgtctgaattcccatttgcaccagtttccctttttcacagacaagacaagattccctcagataactaagccattccctggccatgagttactacagtttcggtcattcattcagtggaaaagcgaccagggacagaaggcgccgccataaaggtcacctggcccgagcagacgccaggtcgctgcttcttccttggctgctgacattttaacagcggcccagacagtctgtttccgctttccccaaacaagcaccctggagaccctcccccgacggctcgaggcgagaaacggggcctggcccaggagccggtggccgcgacctcgggtatgcagtggcgccctctgcaccttgggaagcgcccgacgcacaggacagggaccgggcaggaggcaggggcggccccaggagaccgggcagcggacgggggagaccgcgggggacccggaaggggatgggggcggccgcgggggtcggggcaggggatgggggcggccgcgtcggtcggggtagggttcgggggcgcccgcgggggtccgggcaggggcggtggagacggcggaggtcggggcaggggacgggggaggccgctggggacccggcaggtgacgggggaggccgcggggcaaccggcagggaacggggttggccgcgggggtcgggacacgggtccggggcagctgcgggggaggcgggaggtgccggggcggtgccaggtggcagctctggaagacgttccacaggaagctctggtcgggcagcgccgcgcccgcagcaggcccagggccgcccaaggccggggcggtaggagtaggcggccaagggccaaggcgcgcggctgggctgaggcgcgtgcggcgactggcgacctcagagcgacaccacttccgcctctgccggggcagggccaggcgttaccgccgcttccgggggcgcaggaaatgcgcgttgtccgagatcctccggcgcaggccacctgcgcgcggggccgggaaggcgcttggaggaaatgtcccgcgccgcgacccgggacaggcagtgatggagcagggatttcgtttgccttttagttcttgtataaaaagaagttttgacgtgaatgtgattcacgctaacagtcggaaactctgggcggggcgcggtagctcacacctgggatccctgcgctttggggggcggaggcgggcggagctcttgagcccagcagtgcggaccagcctgggcagcggggctagaccccatccctacaaaaattacagcaagtagtcgggcgtggtgggctcctgtggtcccatgtactccgtgggctgaggcgggaggatcgcctgagcccgggaggtcgaggccgcagggagccgagatcactgcagctccagcccggtggacagcgagactctgcaaaaaaaaaaaaaaaaaaaaaaaaaagcaagcaggccgggtgcggtggctgacgcgtgtaatcccagcactttgggaggccgaggccggtggatcacctgaagtcaggagttcgagaccaacctggccaatatggagaaacccagtatctactaaaaatacaaaattagccgggcgtggtggcgcacgcctgtaatcccagctactcgggacgctgaggcaggagaattgcttgaacccgggaggcggaggttgcggtgagccgagatcaggccattgcactccaggcctgggcaacaagagcaaaactccgtctcaaaaaaaaaaaaaagggcaaaacacaattcgggtgggaagggcagtgtgcagcgttctccgttgtctgttctgccccgaaaagcttcccccctttaggtttaacctgcgcccccgcgctctgcatcagcgccgcccccgaccccgtgcagttggaaacactgggcgcctccctgccgggccccttcccgcccctgtggtggtgcagccctgcctcccgcaagacagcactgccttcgtgctggacacagttctaccgtggagcctggagtgcctgtagcacaaatccccagaattgggaagtgcccagctttgggccactgtgatccctgggtctttcctgtgcgcgtagtctcatgccgccttccaccctagtcctgtgtcctgtgccccggttcaggatactacaattattctcattatttcatggggttattccagcttttcaggttcttcagtgcctcattccatgaatgctaacttttttcatcctcatagttcctagggttgtctctgaattttcacccagttgcctaccaagatgttgtctgtgtctactgcaggggacggtgcaggtctgaatatcttacagctcacctttttggtgcctttgatccgtgttagaaattatccacatcttctctctgggcaatattctactttttatattgacccaattattttacttctttggtgtgtcttttctcctaacacatatgggttcactttgaaaccttgaaacccacatttacaaaaacattttcaatatgaagcattgttccatgactctttactggagtaccatcaacatttacatttccagaccacccactgcccagtggttttcttggtctcagtactcatgaaaacggtctgaaggtttgttttgggttcctaagtagtagacacacgcacaacattgcctgtcagttatttcttggaaactaaatcagcccttctgttgccatcctatcatgcttcaggggtgcctgtgctagtttttaattatttgtcctaacacttaaatgtttgctcaaacgcccatattaatacttcctctgagtttacaaaaggatttactttcttactggttgggatgaagctgcctgaggttgccacctgttatttttccttcatttattggaccatgtcatcccattacatgtcagccgtggaggttttcaaactgtggtccctggacatgttagaaatgcaaattctcaggccgaaccaggactgaataggaagatctggggtagggtccctccaggactgaatcggaagatctggggtggggtcccccaggactgaatcagaatatcatgggtggggtcccccccaggactgaatcagaagatcggggatggggtcccctccaggactgaatcggaaggtatggggtggggtccccccaggactgaatcggaagatctggggtggggttcccccaggactgaattgcaagatcatgggtggggtcccccagcactgaatcaggaaatctggggtagggtccccccaggactgaatcggaaggtcatgggtggggaccctcaggactgaatcagaagatctggggtagcgtccccccaggactgaatcggaagatctggggtggggtccccccaggactcaattgcaagatcatgggtggggtcccccaggactgaatcaggaaatctggggtagggtccccccaggactgaatcggaaggtcatgggtggggaccctcaggactgaatcggaagatctggggtagcatccccccaggactgaatcggaagatctggggtagggtccccccaggactgaatcggaagatctggggtagggtccccccaggactgaatcggaagatctggggtagcgtccacccaggactgaatagaaagatctggggtggggtcccccaggactgaatcggaagatctggggtagggtccctacaggacaaaatcggaagatctggggtagggtccccccaggactgaatcggaagatctggggtggggtcccccaggactgaatcagatcacgggtggggtcccgccaggactgaatcggaagatctagggtagggtccccccaggactgaatcggaaggtctggggtagggtccctccaggtgatcctgttacacaggttagagaaccacggcattaggggtgggaatttgacaattcttttttttttttttttttttttgagacagagtctcgctcttgttgcccaggctacagtgcagtggcgcactcttggctcactgcaacctccatctcccaggttcaagcaactctcctgcctcagcctctcgagtaactgggattacaggcacccaccatcatgcctggttaattttttgtatttttagagatggggtttcactatgttggtcaggctgagacaattcttaaactgtcattctttactcacttatttgcaggaattcttatgtaaagaactttccctaatcaacaaggtttccctgaattgcaatttgtagagaaaagacaggataattgctgatcttccttcaagtgtccattcccagtgttaggagttagtgccctaggtacctccaagagtgaccaattacatgtgtttggttggttttggctttgaaaccaccactatgaattcatggttttcatgtattagagaccactttctaggtgcttgatgtgtctactgctactggggcagaggtagaaaatgtgtatacggtaaaagaacaacaaatgagttcacgcttatatttctatttcaaatttagtatacggttttacacctttttctcagaaaaatcttgttttattttttgagatagagttttgttcctgttgcccaggctggagtgcagtggcacaatctcggctcactgcaatctctgcctcctgtttcaagcgattctcctgcttcagcctccccaacagctgggattacaggcacctgccaccatgcccagctaatttttcaattttagtagagatggcgtttcaccatgttggccaggctggtctcaaactcctgacctcaggtcatctgcccacctcggcctcccaaagtgctgggacttgggaggattttcccttgccagaaaaatcttagttttagcattaacataattagttattagctttaactcccaccccacataatttcaaaggattaataccaataagacgagtaatggagatgattgattgaaatttaggattcagtggctctatttgtctttagactatggctcactaaatctgcacacttgaagtgctgtgttctagcgatcctctgatgacacatgaggtaataggctgcgtgactgtcaccagcctgatgtgcagttgggctgcagaaccccgtgatgctgcctagcccagccagccccaggtcactcctcagactcaaactcgattctgacaccaccagcacctgggacgctgcctaggggctttctctggtggcaggagcacgtcctggagcaggccaggggtgcccggaattgaccatcctaaacctgtggagtgtgggctggtgaaggaacacaccagctcccacagtgagcacgggcccagctgcccacatgggacccagctcccggacgccgcatgccaccgcctctttcctgtctcacctcccacttcccttcagctgctgctcagggccaccttccaaattttggtctcacggttggagcctgtagaatgcaatccaaggaatttagattcattcatttcagataccattctttcaattttagggactatcttaaaaacttagtttggtaatatgtaaaacacttaacaatttcaaagtccagatattacttcagagtctatttcggtctcacttccaccactgacccctatcctccacagcaaccactttagacttttatctttgtactgttttaagaaaaagcaatatatatttgcatcatatgatatgtactctgccccttatcaataggcgttcctcattcctccttctggtacggagttccccactgcacgaattaatgttcccaatcccctactgatggacattttgattgtttccagttttacaaatgccacagtgaagaactttgtggcaaacacattcaggctgtgaaaagaactctgtgggtaaagtcctttcatttctttgccagagttttttttgaggcagattctagaattgctgagtctaagggcaaatgccatgtcattttgttagatgctgccaaatcctcttccatgaggctgcaacgttctgcattccacagtgactatgagagtccttgtaccccacagcttcataaacaaagcatgacagcaaacctgcacgtttacccatcacacagttgagaaattttatctactttcacctttttttttggttagcatttttattcccagcttttttgtggtataatgcgcagaaggtaatgaacacattctacctgcaagcttcttcctgtgcctttggaatctgctcctgccagtctgcagggaaccacggatctgctttccgtcacgtaggaggcattctcgacaccctctgtacacagcatgcgctttatttggcttctcttacgcagcgtagtgactttcagatttattcaagctgctgcgtgcgccaacagtccactccttcctagtgctgaggcccccatcacatgagcacaactgtttcttgtgtgtgatgtgttgttctctggctgtgcactgccaaaaaagacatcattaaaaaaaatttaaatataatgtaagacctgccttgtcttaggaaacgtttttctggcagtggctcacacctataatcccaatactctgggaggctgaggcaggaggactgcttgagcccaggagtttgggaccagcctgggcaagagggtgaaaccctgtctctaaaaattagccaggcatggtggctcacacctgtagtctcagctcttagggaggttgaggtgggaggactgctggagcccaggaggtggaggctgcagtgagccgagatcacaccactgcactccagcctgggcagcatggcaaaactctgtctctaccaagaaaaaaacaaaaaattaacagaaggaaaaacaaaagggctttcttatcaaaaatacactttaaggaacaaatttatcatattaagttggtgcaaaagtaatcgtggcttttaccattgaaagcaatagcaaaaaccgcaattacttttgcaccaacctaatattattttctaatgacaaacttggaaataactgtcattgttctctaaaaagaacagcctaaaaataaagcagcagcccatttacttctatgccagttcttttagcatttggttatttaaaccggcagtccctaacctttttggcaccagggactggtttcacggaagacactttttccactgacaagtgtggggatggtttggagacgaaacggttccatctcagatcatcagtattagattctcataagcggggcataacctagatccttcgcatgcgcagttcacgacaggattccactcctatgagaatctaatgccaccactgatctgacaggaggcgaggctcacacagcaatgatatgacagggggcggagctcacacagcaatgatatgacagggggcggagctcacacagtaatgatatgacagggggcggagctcacacagtaatgatatgacgggggcggagctcacacagtaatgctctggcagggggcagagctcacagtaatgctctgacgggggcggagctcacacagtaatgatgacgggggcggagctcacacagtattgatgacagggggcagagctcacagtaatgctctggcaggggggcggagctcacacagtaatgctctggcagggggcggagctcacagtaatgctctgacgggggcggagctcacacagtaatgatgatgggggcggagctcacacagtaatgatgacagggggcagagctcacagtaatgctctggcagggggcggagctcacagtaatgctctggcagggggcggagctcagtaatgatctgatgggggcagggctcacacagtaatgctgacaatgggtggagctcacacagtaatgctctggcagggggcggagctcacagtaatgctctggcagggggcggagctcacacagtaatgctccggccgggggaggagctcacacagtaatgatatgacagggggcggagctcacacagtaatgatatgacagggggtggagctcacacagtaatgatatgacggggcggagctcacatagtaatgatcacagggggcggagctcacacagtaatgctctgccagggggcggagctcacacagtaatgctctggcaggggacggagctcacacagtaatactctggcaggggacggagctcacacagtaatgctctggcagggggcggagctcagtaatgttctggcagggggcggagctcacacagtaatgctctgacagggggcggagctcacacagtaatgctctgacagggggcggagctcacagtaatgctctgacagggggcggagctcacacagtaatgctctgacagggggcggagctcacacagtaatgctctgacagggggcggagctcacacagtaatgctctggcagggggtggagctcacagtaatgctctggcagggggcggagcgcacacagtaatgctctgacagggggcggagctcacacagtaatgctctgacggggcggagctcacacagtaatgctctggcagggggtgcagctcacagtaatgctctggcagggggcggagctcacacagtaatgctctgacatggggtggagctcacacagtaatctctggcagggggtggagctcacagtaatgctctgacagggggcggagctcacacagtaatgctctgacggggcggagctcacacagtaatgctctggcagggggcggagctcacacagtaatgctctggcagggggcggagctcacacagtaatgctctggcagggggcggagctcacagtaatgctctggcagggggcggagctcacacagtaatgctctggcagggggcggagctcacagtaatgctctggcagggggccgagctcacacagtaatgctcactggctggctgctcacctcctactgtgtggcctggttcctaacaggccatggactggtaacgatctgtggcctggggactggggaccctgatttaaagaatcgaggacacactcacctagcaaaccatctgccaagaaaaaggaggaaaagcaccaacattaatttgaacttagaaataaactacaataaggccagacatggtggttcacacctataattccagcacttcgggaggccaaggaggaacgatcacttgagcccagcagtttgagaccagcctaggcaacacagtgagaccctgtccctacaattacaaaataaatgagctgggcgtggtggtgcacacctgtagccccaactgctcagaaggctgagtcgggaagatcacctgagctgcccaggagtttgaggctgcagtgagctgagactgcaccactgcactgatcctgtctcaaaaaaaaaaaaaaaaaagaaactacaacaaaatatctggattttgatgtaacagaatacaaagataattacatttgatttttaggtcaacaaatatgactaaagtcacaacagtaaaatattttaaatggatttggaaataaaagaaagtttgttcatttatattttatttaagagctgtgcccagttttatcttgtcacaagaatgaagcaagggacaaagtgccacgctccccggccactgggtgccaatcccccttcaatgtactccttcttccccagagtgcagaagcgtataaagacagttatgacattgacacatgcatgagctattatacataattacaaaagctgattctgtcatcaccgcatcttgtctcatcagtaggagtgaatggctggggggacagtggcacagtcagcctcattcaaagttttgtcgattatgggtctatattccacagtgaccttgaaaagaagtcagtggtaagttaagcacaaaaatgtacaaaaagccatctcttgtgttccttttgaaaaattttaactataaaagtagatttacggcatgtaaactttaaggtatttgctgcagtattttccaataacaaattcaaaaatgatctacatgcgcaacaggggactgtaaatgacggcagatcggtagagtggaacagagcaacgaaaatgacactgtaccagattctcagtgctttgctttacaaaaatgctcccatcatgaaaagtgggagaacccttgtctataccaagacacttcatgtttaaactatctacttccagtttttctacttcaaagtaaatatttatataggtagaacatccctaatccaaacatctgaaattctcccaaatctgaaactttctgagcaccagcatgacattcaaaagaaatgtgctatggagtcagatcttcccattagggatgctcagacagtaagtgtaatgcaaatattccaaagtctgaacaagcctgaaatccaaaacacttctggtcccaacgatttcagagaaggaatactcaagccgtgtattaaatatgcacacacaggaaaaggtaggcacatatacaaagaaatttaaaccataatgggtcatctctggttagtgagctcttatttcaatctctttgtactttctaaaatgagtacgtatttcttgaaaaatcactgaaactggctgggcgtgttggttcatgcctgttggggaggccaagacaggtggatcacttgagctcaggagctcaagactagcctgggcaacgtggcaaaaccccgtctctacaaaacatacaaaaattagccaggcatggtggcatgtgcccgggaggctgaggtgggaggatcacctgagccgaggggaggttgaggctgcagtgagacgagatcgagccaccacatttcagcctgggcaaaagagatgagactctatctcagaacaacaaaaacaaaacaaaaaacctgaacccggaaacattaaaaatagacttgtgctaagcaagtgtgacctctctatactatcaggaaatggccttcatgataaattctgaaaatgacctactgcctgaatcacagacacactagatgatagtgagagtccaaaggtaacttccacagacacagctaagtgattatacgactctcccttacaagttatgaaaagcttaagggtaaaagctttctatcttcatgatttctgaatctcaatgcccagcggaaatgccacacgggtgaactgtgcttgtgtggaacaagctgcaacccccctaccacaccctcggctggctgttcccaagacgctgtgcttgtgtggaacaagctgcaaccccctaccacatcctcggctggctgttcccaggacgctgtgcttgtgtggaacaagctgcaacccccctaccacaccctcggctagctgttcccaggacgctgctcaccccaaccccgcctccatttctgcccttctctgcttgctcagtgcccaggggatgctaagggctgcacctcatcccctctgctcccctgcagatgcttccagttggcccagcccatgggaggagaggggagggatctcttctgggctcccttggctcgggactggtttctggtagtggctgtgtccccactacacagatgctttctcgctaggtccataatcatcatctcttcccctgccaccaggccttggacacttgctcctgcccagtgacgtccatctggcccacaccacagagcaacccttccttaaggctcctctgaaccacctgcaggcactggattctgtttccagcccgaagcccaactgctgtcagagtgcctttttcagcggtgcctcaaatctgtcgggaggtgatttaaatctggcctgctcctctgcgttcaccatcagcaaggccagcccgcagacctgggcggggccgtgtgggtgctgggctgtggtgagaacgagctccacactgaccttcccagtgctgacgtccacataggacagggtgtgcttcctccagtgctcctcaaagggcttcttctgttgcccctggatgggcttggagtgatcgtactcatcaatccgcacctgagcccagaaacaccatcacatttctcattactctaacagagcaatacagaaaaaacacagcaaacgttaaaatgatctaagagacagatgccctagaacccattccatttccacttcagcccaggaggttggcaccatcaacacgttcagaacgcacagaggccacatggctggccagcaatgtgcagccagcagtgagtccagagtaatccatgtccgcatgttcccttagacatcctttatgtacctaagagtttatcaaatactttgtctttttgctccaagcgctgggagactacctcaatcctttctttcagcctgtttttattaaaaacactttttttttcttttgagacagggtctcgctatgtcacctgggctggagcgtaatggtgtgatcacagctcgccagagccttgacttcccgggctcaatcaatcatcctgcctcagcctcctgagcagctggtacctcaggtgtgtaccaccacgcctggctaattttttaatttttgtagagacaggtttcgccatgttgcccaggctggtctagaactccggggctcaagtgatctgcctgcctcagcctcccaaatgctgggattacaggtgggagccactgcatctggcttctattctaattaaaactcgttgtcaccaactaaatttatgctcctggacaggcacagtggctcatgcctgtaatcctagcactttggaaggccaaggtgggtggttcacttgaggtcgggagttcgagaccagcccggccaacatggtgaaaccccatctccactgaaaatacaaaattagccaggcacggtggcatgcgcctgtaaccccagctgcttgggaggctgaggcaggagaatcacttgaacctgggaggcagaggttgcagtgagctgagatcgcaacactgcactctagcctgggggacagtcagactccatctcaaaaaattaaaaatcataaatttattattattctgtattctggcaaacacggattcatatactttgcaggaaagactcttaatatgtatgaggagacgagcaaattctgagcagtgatcacagccatcagcatattctagtggagggtaaatcagtaaaatttcatggtgaataaaaatgattttcccattcactgtgttcagctgactggaaaggctgccaccagccgcccacacatggccctgaaccagcctgtgcgcctgccttgtggagcctttgtccttttgctgatgtggtttatgctgaacttgcatttgcaccccaagcttccctttccgtcgttttttgctatcatatgtgaaaaactcttaccaggcagaatccaacacgtgtgctctgcacaaaaatcagttcatctgaagaacaagtgaccacagggcaggctccgtaatcaaaccacaggacaggctctataataccttttccaaaccacaggacaggttggaaacagtggcttactcgttatttagtaaactggcatttcctccacagggcaggtctgaaacggtgacttacttgttatttaataaactggcatttcctccacagggcaggcttgaaatggtggcttactcgttatttaataaactggcatttcctccacagggcaggcttgaaacggtggcttactcgttatttaataaactggcatttatttcctggtcatgccacgctggctgcacttctaaccttggccttctaacagcaaagcacattggcttggagatgccactgctggcatcagtggatgccgacccaaagcaaggaacaggtcacagtgatccagaaaatggcgagaacccagggatcaaagttaccagagggaaaaaggcattttttggatatacttttggggaaacgacataaaatgcagagaaaatgcaggggtggggctgagtcccaccaggcgggaggaaaaggcaggtgcaggtgggcgtggcgagaaggcgcaccttgtagtcttccccggcgtgcgcgccccgtgactccttccccgcctctgctccattgacggtctgcagcgcacatagcatcaggttctgcagctccagggtctccaccaggtccgtgttccagaccattcctggggacacaaaaagttccatcaggggcaggtgggacccagtcacacgggccctccgagctgtcagcctgggcctgctagtccatggagtcactggttgtggctttacagctgggggccagcacccatccagacagcaagcatggaactaagtcagcactgacgggacagacaccagcccaccctgcagaaggcagggcccaacagtgtgcacagagcccactgtctgctcaccccggtcaaacgtcttcagatgcttcaggtctccatagagcttgctgattttcccacaaccttcttgcaacaagcttcccacacggaacacggcagcatgattttgcgttgactgtggcacaaaatattatttgtaaacttttaattcatagaagcagccataccaagaactgcttaacttttagacctgttgttttgcatttcattttatttatgtaaattaaacagaaaaattaggaaatttagactatgagtttattactctgaacttaaaaatgaagtcttgactaaagcttctgaataaatgtttctattatatacatatcttagacccacacacatcctttccagcgggatacagccaggatccaggacgccaagcagactgcctgtgaggcaccatgttccatacggctccacggccaaccaggcagcgctgcctccccacacccctggcgggactcctgatgtggggtctggtggtgaacgtgacacgagccagcagccctgtggtgatacacacaaggaggaactgagcagagccctgctgatggtggggttggaaccgaaggtcttcaaggagagggaggggcgtgggtggctggggcccttggcccatctggctactgtcttctgcctattttgtagaagctccttgtacactgagttccttcatagttttactatcacgagaaacgtgctgggagtggacctgaagtttacttaggtatgctgggaactgggcatcagcttttgcttcctgtgggacacacaggcaccacctccgtgatccctcctcctccttgcttctccctctaactgtgctttgctccactgaccctaattgtctcttcctctaccaatgcaccttcatggttcaatttggacatttcatctgattttccttagactcatacataatcgtaacactgtaatgcacatcaacctaacggtttttcaggaagaacaaatgaaaaaaattgcatctcagaatctagtattacattctttcatgtccttcagcagcgacgttttcgtatcatcttttcgtatttctggttacattatttcaaggcattttaaattttttgtttgaaatgcgaatgagatatttactgatgtctgagcagattactgctggcacattgcaaagctactgatttttacatacaaatctcttatccacataccttactacattcttgttttgtttctgttagtttttccatttattctctggaaattttttggaaattatatctgtaaataatggaaactgtatctattccttttcaatatttactgccaagaccagctgggtcatggaaaccctaacccagtggcactagaggaagtaaagacacacacacagaaatatagagtgtggagtgggaaatcaggggtctcacagccttcagagccaaaagcctcaaacagagatttacccatgtatttattgacagcaagccagtgataagacttactgaaagtattccttacaggaaataaagggatgggtctggctagttatctgcagcaggagcatgtccttaaggcacagagcgctcatgctattgtttgtggtttaagaacgtcttaagaggttttccgctctgggtgggctaggtgttccttgccctcattacggtaaacccataaccttccagcgtgggcgtcctggccatcacgagcatgtcacatgctgcagagattttgtttatggccagtttatggccacatttgggggcctgtttctaacaatttacctcatttctttttttgattgttactattaatagccagagtcagcagaaaaatcccttcccccaacgaaatgcatttccgcaagcataggaagctctgtttgttcagtgctgactccggcacctcacggagcctgggatacagcaggcaccaagacacaccttgtttggtgggaacacttctagtattctcacttcaaactatctcagatttgccatttctatatcctaaggcatgttcccattctctaacgcaagggttccttctttcccagctggcctccaaccctacaaaagcactgcagggcatcactcagccttctgtgccttagtcacgctgttcttctcaccgttccacaaagcctccctcaagcccagcctcacctgaagaccgaagggcacgggcctctgaaaatgtcagcagggaacctgttctcttgtgtctaacaccaaatgcctttcagaataggactaaagcagtggacttcttcctagaaaatacgcagcaattcttgcaaatagtagacaagagattctcattcatggacaagaatccttgttattagaggaattcagtttcttagactgactatatatcaggttctccacggccccatggctaatggctgccatactggacggcagtcaacatttccatcatcacagacggtcctactggaccgactcccagcagcacaggccacacagatcactgtccaccggccgcccactctccctctctgctgagtatatttaggggcagcaacaggtccagcttaaagacgtttccgagctgctggaagccaggcatgaagacatgatcaatatctgggcctgagatgtaagcaccagtcttgtgttgaactccaggaaacctctaagagaaagctgccctgctggggacggagcttctccggtggtcctgcggctccctctcctccacgctgtgactcatccatgacagccagcgacggtcagggcacggcggtcatgcccaagcacacacaagtgaaccacagaaggctgtcctggatgctaagcagtcactaattctgccctggcctgctgaccttctatgtggagaagaagtgcacttctggtctctttcatattcttgatacagtgaggagtatgtcctactgctgtttacctccagatactggtgcagcctcgtatgtttattgcagcactagtcacaatagcaaagtcatggaatcaacctaagtgcccatcaacggacgaccagataaagaaaatgtggtacatatataccatgaaatactacttggccataaaaaaagaatgcaatcatgtcttccgcagccagacggatggaacgggaggtcactatcctaagtgaagtgactcagaaggtcaagtgtcacacattctcccttggaagtgggagctgaacagtgagtacacatggacacacggagtggactaacagagactgggggctccaaaaagcgggaggggtggggatgagcaattacctgctgagtacaacacacacgacttgggtgacgggtacatgaaaagcccagactccaccacctcccagtacatccacacaaagctgcacctgcatccccctagatctgtttttaaaaaaacaaaaccagtgcagggccaggtatgcagccagcctgctcactccagagcgagtccaggctcttaccttctgcatgctgagtcgcagttccgatgttcttatgcttcttccatcagcaaatctcaatttgtcaacattcgtgacagattcttccccagcatttggtttaattggagggactttatctcctaaaacaacaacaaaaagagctagaatttaacttttgaaaaccgttttaaaaaaacaaatggatttagtacgacacacaaaaatgtagcatagccgctcaaggagcctggaaactgtgtaagtctcctgagctaacacactgccaacccaccctacatctgaggccatctgttgagttggggccaattttaaagaacagacataaaaggcaaaactgttggcacacagtagatatccattaagtgatcttagagtgaataaactagaaatcatctctaaaattaaaaaattaaaatgtaggccgggtgcagtggctcacgcctgtaatcccagcactttaggaggctgaggtaggtgaagcacttgaaatcaggagttcaagagcagcctggccaacgtggcaaaacctcatttctactaaaaacacaaaaattatctggcatgagaactgcttcaacccgaaagatggaggttgcagtgagccgagatcgcgccactgcactccagcctgggcaacagagcgagaccctgtcttacaaaaaaaaaaaaattaaatgtatacagatttatatacattaagtgtatataaatgtcactccactaacgggaaaaaatgacaccttccagatggtggtcccaaggggccggccgccccactgtccttcacattagggggaggaaggtggctgctgtgtgcttgcaagtcacctgctgatttggactattgtgtgctctcatctatacttcaagatttgcaattttttttttttttgagatggaattttgctctgtagcccaggctggagtgcggtggcaccatctcggctcactgcaacctccacctcctggttcaagcaatcctcctgcctcagactctggagtagatgggactacaggagtttgcaaccatacccggctaatttttgtattttcagtagcgatagggtttcaccatgttggccaggctggtctcgaactcctgacctcaggtgagccacctgcctcagcctcccaaagtgctgggatcacatgtgtgagctgctgcacaaggccaagatttgcaactcttgtgtttccaagatgtcttgaaaaaagttttaaaggtttttttttttttataaaattatatatattttttcttcaataagtaacacatgcaggagataggaggtatgaaatgcaggagtccaacaggccctgtcccgcctaccgcctctcctcgggaccaggctgtgggtctcttgacggtctgctcaaatgcttctaggcttgctggtgtctcttttccttttgtttataacgctttaaaaattgatcatccattaaaattgacttttttctttcggtggacagttctacagtttcttttttcttttttttttctttttttgagacagtgtctcctccctctgttgcccaggctggagtgcagtggtgcgatctcggctcacagcaacctccgccttctaggctccaacaatcctcccacctcagcctcccaagtagctgggactacccaagtgtgagccaccatgcccagctaatttttgtatttttggtagagacggggtttcaccaccttgcccaagctggtctcgaactcctgagctcaagcaatcggcctgccttggcctcccaaagtggtgggattataggtgtgagccactgcacccggcctcagttctaccgattttaacacatggatagatgcatgtaaccactttgggaggctgagacaggaggatcacttgaggtcaggagttcaagaccaccctgggcaacacagggagaccctgtccctagaatacatttttaaaaattagccagatgtggtggcgtgcacctgatcgtaccactgcactcaagcctgggtgacagagggagactatgtctaaaaatacacatatatatattttttgggggggtcgggggttgggggagaagtagggatgctacaagcattttttctttccttttcatttttaaaaattaaagcgtaaagatacagtaaaataaactcatcatttttaatgcaggtttttcaaactttgacacacacagagctgtgtctgtaagcctcagcacaatcaggaaacagcctctggcaaccaccaatcccttttcttccctagatgtgccttgtccagaatgtcctatcaataggaccacaggcgtgcagccttttgagtccgactccacagcattctgcgtgagatgctgcatgtgtgagcggtttctcagatgtcaagtatagggtattctcacaaaatgttcttttctgcattttcaaagaaagagaagctcaaaatttctacactgctctgagagaagtggtatcagacctcactgcgacaaagtgcagggctatggagtgagacaagcacaacctgtggcgtcaggaacgaggcacctgaaccccgccttcgccgatgatcagcaacggctggggatgagacgccggctctgcatgtgctggcctcctgagctgtcgtcagatccacagagacacagtgtctgaagtagctacccttttaatactgcctgtacctttctaactacagatagaaaagggcgcacgtttataaggtacggcggtgctagtttttatttcacttgagtccatacaaaaagcaaaaagcgcctgttctataaaaacagcagaaatgatgctaaacagttaacaccagagaaagctaacgggaagaacatgggcctggggtcccaccatccttgccacgcaaacatccaccagtgcctcatccacctcacactgttctgagcacacgaggctgcataacaaccgtgaggatctctggaggtgggaacgatgctaactgtcctgttcttcgcgccctaagaacagggcactaagaccctgtctcaaaaaaaaagaaaaaagactaacctcctgcgccttctcaaatagtctgggtcctgaagaaaacacttaccaggcctgcacgactctgcgatgctcagggcacatgcctgaccagacaaccaggtccaatagcgagtttgccccgaggcggttgacaccatgtgcagaggcacaggcggcctccccacaggcgtacaggccgggcacaatctgatcctggccattcccgtgcctcaggacctgtggaaaggaagatttcaggtgaaatgtcaagatgcccattcctccacaagcccacctccctcaacagggtgtctgtgctgcaggtcagagaaagagagggaagtaggtcgggcatgcagtggctcacgcttgtaatcccagcactttgggaggctgaggcgggtggatcacctgagttcaggggttcgagaactgtctggctaacatggtgaaaccccgtctcaactaaaaatacaaaaattagccaggcatgatggcgggtgcctgtaatcccagctactcgggaggctgaggcagaagaatcgcttgaacctgggaggcggaggttgcagtgaggcgagatcgcgccattgcactccagcctaagtgacagagcgagtctccatctccaagaaacaaagagacggaagtaaagaccgtatctaagaaggaagtaaggaccatagctactcttcttcagagggaaacttccgaatgtataccccagtttcccctctgcccctgagcacctgctgttacaagcaggtcagaggacctccaatgtcagcatctgcgactgtcccccgtgtcccatgttcccgaggccctcaccacctgtgctccagctcagacccaggagcacggcaggtggaggaacatcagcaggggagactgatgttccagactcttctaccccctgttcacctcttcatctatgcggggaaagtaacagcttccacccacctcgcccaacaaggaggctaagtgactgacaagctctgtgtgaaccgcaaaccactcaaaggtatgaattataaagatccctcgatgtacaagatcattagaaatagcaattataaagatcccttgatgtataagctcattagaaataacacaagatcatataggaaagtaattataaaatgggaaaagctgcaaatgatgtatctatgacagtttacttaggaggaataaattattaagcctccttccatcctccactgatagaaatttcaagtgcaatttagaaaacaatacagtactttctttaaggaaacatctgtctcttcctctaagatctaaagagacaactgcaagatgggccccgttgtcccagccttctttccagctgtgggagagaagccagcaccatcacctgcccctcgtagctggtgggaatgccgtccatgttataatgcacggtggggaggacagggatcggctccttcgtgacgtccacaccagcgaagatcatggctgtctctgaaatgccgggcaagggcatggccagctgctctggaggtaggtggtgcagctgcaggtagacgtgatctttctcagggccacagcctctggtaagacagaacaccatcacataaggcagagaatggcaacggcagcagacctgagaatacgtcatcttggaagcgtgtgagttgcaacatgttttgatactgaggaaaatttcccctcatgtacggccaccctcccatcaaatcttttctaagcatctactgtgtgccagggacaatcctaggtgctgggacacagctgagaaccagaacaaatactctgcccttactgaactcacactcgtctcagggatcacagcctgcagcggctgtccttggtaaaagcattaggcctctatgccaaatagtcgtccctgcgtatccgtggcaggttgggtccaggacccccacggacaccaaaatccgtggatgctcaagtccctaatataaaatggcagagtatttgcatataacctatgcacatcctcctccatattttaaatcatcctcatttcaagttttacatttaagttgtacagcaactccaggattactcatagtacctaatacaatgtaaatgcaggtaaatagctgctacactgtgttgcttagcgaacaatgacaaggaaaaaaaaaagtctgcgtgtttgtaaggatgcaattttattttcagtacatagttggttgaaaccacacatgtggaaccgatggatacggagggccaccatattccaaaaaaccatccgacttcttttttttttaatataaaaatgtaaaacctctaaaggccacaccagataccagcagatatttagcaagtgttatcacattaaagaacagggtcaggcaatgaaagagctgcaaactgttcttctgaaaggcaaatgacccacacactttgaaagctgtcgaaaaacatctgtgggtatcagacaccacacccaaggctcacacgccgacttcaggttgggtgcgtgtctctctcttccatactccgtcacatactcacacacactaagagaaactctgttccacagatttgagaaagaaactggctaaaattttcaaaatgtaggtctttaggaaaatatcgcagactaacagatgcctgccggcagctgagagaggtggctgtgcacatgtgcctgcacacgaaggtgagggcgagtggtgctgaaactcacagaagcaaccccggcccgtgtgcccgctcagacagtgctggtggtaaaccacacgcaccttccttcgcggatctccagagtcatccaccgagacaccacatctctagacgccaggtccttcgcgatgggggcgtatcgctccataaacctttcgccttgactgttaatgagaatgcctccctctccacgacatccttccgtaatgagacaaccagcaccatatgtgcctgcaaaaaaccacacatttataacctaacaattgctgggtctctatttcaaatgcattacttttttttacaagatattttttgggggagagacaaaaaagatatgcagaaggcattatatgcaaaactgaacagaaagaacagttaagatacagtagaaagtctggataacaaaaagcactgacaaggctgacagctgcagcagaggctggggcagagtggcgtccccagagaggagaaaggccggcccacagacctctggccaatactctgattacagcccggtgtacgttggatgcctcaaattttgttttaatttttgaacattcttttgcgctacgatactgtggtgactagttaagaatactagcttggagaattcatatctaagttacccaaacagtggcaaggacagtaataatgattattttagttcatctttacactgcacttgctatgggcagttctagctgctttccacatattaaactcatttaagtcttacaacaactctgggtagtacgaccccctttctcagtgacaagcaaattaacgcttggtaacatccagtcatgcagctgaggacagagctcaaacccaaacctgggcagtccggcggtctgtgccccaaacagcggctctgtgactcctcagtgcgatgagaaacagggcgtgccaagctctcgaattttaacaaaggagatcaaaaaccctaaactaaatgtatttcaaaagctacaatttttattagtatacaaaaagggcaatcttgctttcaaaacaagaatgtgattcttgcatctcacctgccttttgattttctaagtttccatgctctcttttctgtggttacttctcacatattgaagacaaagcatgagaagtggagctctaagcaaattacagagggaattcaggggctcactgacattttactgattaaaaacagtaataaaaaatacaacaggccgggtgcagtggctcatggctataatgccagcaccctgaggggccgaggcaggaggatcgcctaagccctggcgtttgagaccagcctgggcttaaaatggtgacaccctgtctctaccaaaaacaaaaaaaccctcaaaaattagctgggcatgctaacacatgcctgtagtcccagctatttgggaggctgaggtggaaggatcgtttgagcctgggagacaaaggctgcagtgagtcgagattgctccactgcactccagcctgggcaacagagcaagaccccatctctaaacaaattaaaaaaaaaaacctacaacaaatccatttcttattttcatcccttccagggatcagaaagctgacactgacagagaaagaaaagacacaggtctggttctttggcaccacttcaggggtctccatcgtccacaggtcagaaaagcaacccagaaaagtccaggacgagtcacctcaaacaagaggcagacgtgtgtgtgtctgtctctgactcattttgaagaacctcctccaaactcaagacttcaactgtcatttctgagttaatgtctccaaattgcacattcgtaacctcaaccgtcagacgtccccaagacaagctcatcttccccacgacaagctccctcagtggtcacgggggctgagcccagcgcccaacgtcacatggggttctctcatggctgtgtcttaactttacatcccattgtcacggaagctctgtgttgtcctacaaagctgaaatctgcctgtgctgcttcttggttccacagcattcacccagctctcagaatgctcactcagtaaaccccgatggagaccctaccatgtgctgggcgtggagcaccccagttaatgagaagacctgcctgcccgaattgctgacgacctcactgcaaagagggacactgaacaattcctgctttacttttttttttttttttttttcagacgaagtcttactctgttgcccaggctggagcgcagtggtgcgatctcggctcactgcaacctctgcctcccaggttcaagcattcctcccgcctcagcctcccaagtagctgggatcacaggtgcatgccaccatgcccagctgatttttttatgtttagtagagatgaggtttcaccatgttgcgcaggctggtcttgaactcctgacctcaggtgatccacctgccttggcctcccaaagtgctgggattacaggcgtgagccaccatgcccggcctcaatccctgctttactgctggcataagtatcaccaaggcagggtttagggctcttgagaaatgcataagatggtggcccaaactgccttagaggaaggggagtgtgggaaaagtctccttaaggaaatgacattgaagttaggacctgagagctaaggaagctgatcttcaaaaccatgttattacataaaactatggaagagcaatgagtaggcaccacacgcttacaagacacacgagccgaacgctttccgggcaaggcgtcctgccctacctgtggggtggaactgaacaaactcgaggtcctggcaaggaaggcctgccctggtgatcatggccgtgccgtcgctggtgctggtgtgggcagacgtgcagctcaagtagttgcgccagtagcctatggaaacaacagagagcagtgactgcacacagtggcccacgtccggacctcctgtctaatgagatcacagaacggacagggcagcccccgggcaccatcttctcagtgctgtgtgcacacaacccccaactcacgcacaccccacacacatcactgggggccatgccagtggtgctgctaccctgcgcaggtaggatagaagcctgggatcagagaagagacttccatttatattttatttatttattttgagatagggtctaactcttgtcgcccaggctggagtacggtggcacaatctcggctcacggcaacctcaggctcccaagttcaagtgattcttctgcctcagcctcccaagtacctgggattacaggtgtgcaccaccacatccaattgatttttgtatttttagtagagactgggtttcgccatgttggccacgctggtctcgaactcctgacctcaggtgatccacccacttcggcctcccaaagtgctgggattacaggcatgagccactatgcgtctggccctgtttgtattttagatttgtgctgttcaaaaggtttccccagtaagcatatactacttttataatgaaaattttaaaatttttatggattttgtttttttcccccagatttactgaggtatgattgatgaattaaacaaaaaacaatactgtatatatttaaggtgtacaacgtgatgatttattttgtgaactgatgacacaatcaacttaatacacatctatcacctcatacaattatcctttttttttggagatacagacacctaaggtctactctcttcgcaaatttcaagttatattaatgatagccaccgtactgtatgattttaactgtagccaccatgctgtataatgttaactctggccaccatgctctataacattaactctagccaccatgctgtttatcagaccttcagaacttcaccttgtgacgggaagttacacctttaatcagcatcgccacagtctgcattcccccagcccctggcaaccactgtcctactctgtttctgtgagttgtgacagttttagatccacatatgagtgacatgcagtatctgtctttctgtgcctgggtcgtttcacttaacataatgactttgggttcatccacgttgtcacacatgacaggatttccttcgttttcatagctgaataatattcagttgtgtacacacaccacattgtcattaaacaccaaaaatttttaggttgtttccatatctcgggtattgtgaataacgctgcaatgaacatgggggtccaggtgtctctttgagcttctgatttcatgccctttggatatacacccagaaatgaggttgctggagcacatggtagtcctgtgacttttgaggaacctccagagttttccacaatagttgtactaatttacattcccaccaacagcacacagggttcccttttctccacatcctcaccaacactatcttttgtcctcttggtaacagccactctaactggagcgagatgagatgatactcattggggttttaatttgcatttctctggtgcttggtgatgttgagcattttttcatacatcaactggccatttgtatgtcttctctggaaaaatatctattcaagtcctttgcccatttttagtagggttgttttttagtagggtttagtaggttggttttagtagggcttttttttattttttattttttttgctattttagatactaagatatcattagatatatggtttggaaaatatttttttcccaacctgtagttttgctgattttttttcttggctgtactgacacttcttaacttttaaagtggctaaagtaactgccactgtataaaattaaagttttttattttcattatgtggagaagacagacttatctatcccaggaatcagtataaacatagaacccactaaaacaagagggattttgccagaaaaccccatgtgactcttcgggccacagtttcctcatctaaaatcgggagaggtacgctgtgaacctgacggcagccactaccgactactgagggccatgctttctcaccccctgaggcaggtgctgctgtcctcaccctttacaggtgaggaaccacggctgggaaaggccatcaccctcacacggttatatcaaggcctgtgtctgaactgctattctacaatgcctctattttccttaaaataaagacactctaaatggaatttattcatttttacaaaggaaataaagtagaaattagattcctaccctgtggcaacaatagtattctttgctcttatgcgatggatggacccgtcctgtatgcacagtgcgaagacaccacggcactccccattctccatcaggagatccaaggcaaaatactccacaaaacagctggtatcatatcgcagagactaaaagaaagaaaaaaaaagggcaagaagtgttaagccaacctttaaggttttaaggtggtatctgctcatgtgaataggtgaaagaacttgatccaaatggaccaggtaaatccaaggagatcagcaagagtgtcaatgacactgtcagagcccgagaggcattccacgcccagcagtaccaacaaggcaggtgtgctagagaacgcagcagcaacagctcctatgttggtgacacatttcctacttctacacaacccgaagaggcactccacactgtccagtggcagcatgcagctccactcggagtctggtgccagagtgaggtccgcagaccatggggtcacagcccagatgggagctactggcaacacataaccacttaattaattaaaataagtcaaaacattcagctcttcagctacacctgccacattagcaacagccccatgtggctggcagctaccaaagcggacggtcgcagacaagcagattccggcaccgcagaaagggaggcgccagacagcgctgcccgcctggacctgccgttccctcagccagcgcaagttgctctcatgagcctgggccagctccccacatgacagctcctgctccggacggagccgccgtctcctcccaccacacacttgtcgatgcactcagccacagagaagtcactggtgttctaacaacctgcacattactgatccgtccccacgcatcagaaaacaacaaagctcagaacatggattactctgaatcaatactgttcaggatattatttggtcatgccaaagttgaccctgattacccagtcactattgtcacctcaagtctttgtccagtgataacagttaatattaaaacaatccatggccgggtgtggtagctcacgcctgtaatcccagcactttgggaggccgaggtgggtggactgcctgagctcaggagttcgggagcagcctgggcaacatgggaaaccctgtctctactaaaatacaaaaaatcagcaaggcgtggcggcgtgcacctgtagtcccagctactctggaggctgaggcaggagaatcgcttgaacccgggaggcagaggttgcagtgagcagagatcgcgccactgcactccagcctgggtgagagtgagactccgtctcaaaaacaaagcaaaacaaaacaaacaaaccaaaccaatccattcaggaactcagaggtggtaaaagagccttaaaatacttcttctttgtctttttttgagacaggtctcctgttgctcaggctggagtgcagtggtatgaacatggctcactgtctcaagtgatcctcctgcctcagcctcctgagtaactgggattacaagcatgtaccaccatgctcagctactttttaaactttctgtagagacagggtctcgctatgttctccagactggtctcaagtgatcctcctgccttggcctcctaaagtgctgggattacagacgtgggccactgtgcctggcctgcttgctctgttcttacatgctgagtgtcacatatcccaagtgaaaacctggtatataagattatcaattcaacttcccaacatagaggcaacaactcacacattgccttaggggcagcttctcaaggcacacgcctgctcctgtcacatccacagtcgctgcatgtgccccacaccgctgttctctgttgctttttacgcaatctctggctgactcactgggcacgctaacccattccccgctgtcaccacaagccccagcactacgtgtcctgtctcaggtggacggggggcggccttaccctcccgtataaggtgtgcaatattgagtggccggtccgatcagccacacagcagcacccatgggcctgcccgccctttccaaacttgaggctgtgtccgccaaatgcacgctgataaatcttcccatcttcagttctgctaaacggcatgccataattttctacctgtgaaagataaaaacaaacaaaagccttattaacctaaaggagtcaagatattcacagctaatctacactaaacaactttaatacaaatctgcaaacccaaattaacctattttatgaaaatgtcaacacttcatcaaagagaagtttttcttattacatgtaatacatagttcatgacggacaaagacttctctgtgagctttgctaatcaccattctttcggctgccacatctgcctcaactgcttacattttttccaggactcttgtactagaaacagaccaccagagcacccagagcctcccgcccatcaccgcgaccatggcagtgggggcctgctccgtcacgtagtggatggcatcctggtcccccagccagtcggagcccttcacggtgtcatagaaatgccacctccagttgtcctcctccatgttccccagagcagcattgattccaacctggaaacaccaaccactccttacaagccacaaacaggaaccccagctttgtcttccaggcccaaatccacccgctgggggattcagagaaagccaactactcacgcggtgactcccagtgagggctgacctcagcagaggagcagccaggcctgacagattccagatcacaacccctcccagactcacccagtgattccatcccttagcctcagtctcctcatctgtgtggtggagacagagggaactccaggaagggctgactggagcagtgagtgaaaggctacctgtaatatgcttattacctaacgtatctggcacagaaaaggtactccatgaatctctccgcataattttattaacaaatcttcccaacggcatttacgggcatgtgttaaagatcagaagtgcttcctgccaagtaataaactccatactcagagtcgcactcccctgtacccctacttcctttggctgtgtgtgcccaccaccgtcttacccctcagagagtcccagaagacagcagcacagggacaaatgaaacccttgcccttttcttccccaacctaaattctgaatcctcctctttagatgatctccttttcttaaggtgttggggtggcaggggtgggtggggagggtagatggtcagagaaaacccaagtgtgactggagtctgaattaagagtgacaacaaggctcccgcccttcaaagtccccagggaagaggctccagggagagacccctgaatgggtgagctgagtaaggcacagcaagaggccaagtggctggagcacggggaggaggcaggaggctgcccaggtagaaagtgcgaggctgcgcgggacctgcacggagtgggagcacagtggggcacctttctcttacctgcgctgcaacagtgtgtgacctggtaggaaacagcttggtaacacatgctgtatcaaactctgcctcggaaaggccaaatgcagctcgcaaagccggcccctccagcgcctaccaccactgcatcaaattcatgatccactactggatactgagcagaaatctggaaaagaaaaattcacctgtcaatcacaggttccactatgccaaacatgaagactcttgtgccagtgaaagagcttgacaaagataaaaggagcaactgctgggcacacagggcctccatcctgtcctggggctgagccctgaacagtgcggggagaagtaggcacattcgcacctggagaagggactgataatcagattctatgaatggtagagggtctattccatgggatcagactgaggaccacaactctacttcagggccgtgcctatgcttatgcctgagaaggtgccaaggagcattcagtcgctattgtgagcttatgagaaaagaacttctcagcacgtttcagttttccaacagagagagaacaggcacactcaataccaaggaacccacaccggaagggccccacggtcctcttttcagtaggattttatcatctatcacagcagatactgttcattttaatttattgctttacttgacctaaatttaaatctaatttatagatacataacagatacaagtaaaaatgttaacatctatgtttatatttgtacttgcaattaagtattattacactgaaaataatttcagcatgcattggatacctatgagaaatttttcccttatgtctatgactcatatgaaaacaaactggtatagatccttacccccaagccaaaaaaatcatttataatggaacaaaaagcatgaacttacggaatctgaaactttagcagatgccctctcgttccttcaacagtgaagtgaacacctcgggttcctgtttgcaacactgttggccactggagacacagaagacacagatccagagggttagtgtcctgaaggaacaaatgctgtgggggatagtaattcaaacttccccttgcaaactgttcaccttcttatgtacccaggtgctcctgtgcatccagagagctcagctgggaccctctacttaaccctgaagggcagcccaaggggcaaggaaggactgagcccccaggtcctcctttccaccctggcttggcactctagaaaaccaggatgaagcttgtttccaaaaaggatactcactgactcagatacgagatgaaaaagacgcacttcctctgggaagtcttcacttatgctacttagtggaggaggggaaagacatccagatcgtattactgtatgtggtattttgcaaataatgaagcattttaaccggctccatcagagccctttccacattacagttccaatcgtccaggagggcttgcggtcagttcaaaaggcactggacacctgaatcaggagatctgtatcctgcaacagtaaaggctgacagcccagagggaagaggtgtcatcccttcatcacacaggaggatgtcggatgcacactctcccctgcctggttgctgctggctttttcctggccaacgtctacaacttgacatatctcgctgcttaaattttccatcttagaaacctttactcaagaaaactggttttagtgtttagtttttagtggctctgtgtgagagaggtcacactgtcccatatgctaaggttggccagccatttaggggatacgttttccattctgctggcggcattttagaagaccactgaatagtctcagaaatatcatcaagaatagttttaggggctgggcgcggtggctcatgcctgtaatcccagcattttgggaggccaaggtgggcagatcacctgaagtcaggagttcgagaccagtctggccaacatggcaaaaccccctctctactaaaaattagctggtcgtggtggcgggcacctgtaatcccagctacttgggaagctgaggcaggagaatcgcttgaacccaggaggcagaggttgcagtgagccgagactgtgccactgtactccggcctgggcgacagagcgagacaatgtctccaaaaaacaaaagaaaaaaaaaagctttaggaaattatgcactcagcaatcagaagaggggatgtgagggatgtcttcaagtatttagaaatacttgcaattcacaaattacttattatgtgggataaaaaattattcttcatttctccaatttctagtctgtttttattgacataagctaatttagttttttcttttttcagaaaatgagaaagaacgaatattcttctaccttagtataattttttacatggtaaaatcatattttaagaaagaagtctttgaaataattttaataaaaacgttcttgaaaattttgtaaagtgccccattaacataggtaatagcaccaataaaaacagtacattataccaaatgtaagtagaaacagtgagatcactaaatgtttattcgttctttctaggatgttgatgtggaatacacactgcccaccccccaccacacacacacagctggcttaaaaggggcagctactataacacaatcttgaacaaatcatcacgccatccccctggggaaaaggacactaaccctctgcatctaaatctcatctggggcagatatttgaatctggaaagcccaacttcaagtcaatgtcagtctttagataaaactcaaaactacttttgacacaaaactagtcttttgtgccaattattaattttttaggagaaactatcaaacatttcctctaagaaaaaaaatggggaacatataactaaaaggaatacttagaccttgcttaacaatacagaatttcagatgactgaatcaggaggtggagggggaaaagtaacaagtgcagagacattcatatccgaaatctagcaaagtaaggggtcctcatcgaataaaatgcacctataaatcatgagcaagaaacgaatctgcatgtacaacctacacaatcacaaaagcagccaacgaagaacccaaaaacgcacgactttctgtaggaaaagctaccttcatcaagataaaaagacttttacaaaacccaagactaaattttggttccattttgctatcttgccatctggtctgaggtgcctggggccttagtctgcagaaggaacactgggcaccatctgggttggggacaaaggcactggctctatctagcttctctccaaccacaagctaccagtgcccctaaaaagtcccactgaccatgggcttcacctcctgcttgtggacgccctcccagcagctcctaagagcccaagatgcggcgggggtctctgcttggtcagcaccaaccacagcaacacgctagaacggtttacacgctttccgatgttgacaggatggctgtatgactaatcctcacatttaattcaaagagattttcaataactatttcaaaaaggagaaaattgcacaatcacaggcataattcaaatcactattgctgaatgccttggttcctattgagatttttactctgcaatttaaaattactttgtaattaagaggtgggtggctaagttcatttaaaagaaccaaacaactaaacctatccaatttcgcttgattaaataaaatcctagaaggccgattctgaagatgcaatcgtagagggcacactcagacactcagagagcaagggctcagggaagtataaccctgaccatcatcctggactaagccgagcccggccctcgaggtactcagcgcacaggcaagcacaggtcctggagtcctcgctcggtcagtgccctgagctctccgtctgatttttaaaaactggcacagctgcttttaaacaccggcacatttttgtggcacaagggccaccaaacgggacccaaagtacaggtccttaacttccaagatcccgaagtggacatgcacagatttgcgctctctggaaaggggaactgcaagcccaagctcgggcgcgccgcgcttcccaccggacacccacccggccgagcccggccactcctcgcacccacccgggcggtttcacccgccccgccggccccacccacgggctgcgggcggccccgcaggacaaccctcacagacggcggcagaggcccggcccagccaggactccaccccggtgaccctgggcagacacgactcctccccgagtccacccgccaggcagaggcgaggggctacctcagcccgcgaggtcgccggaccccaggcccggaccaaagcggcggaggggacgcccagcaagcccgcggggtcgcgaccttcaccgggacgcggcctacctgctaaggaccgagctccccaggcccccgagtacactccgcggctccccctcgcaccggcccagggctctcccagccccttcccgatccccgggcagggggcgcggggacccggcgcccgctccgctcggacccgctggggaccgtcccgctcctaccgccgcctcgccccccgcctgccctgccccggtccgcggcagggactcaccgccttggccagcgccagcgccaggcgccgagcgcttggcaaccgcgacaggccccggacccccgacacgtctgtagtcgccgccgcgcagtcccgccagtccctgcgcagactgcgcctgcgcaccacggccgggtcaaggcggggcgctagtgggggacattgcgcctgcgcaccacgcgacgcccgggccggggtctaatgggcggggacgccgcgcctgcgcaaagcggacccgcggaccgtggcgctgggtggccacggaggtcccgcgctccccgaccgagatagggcgggccctatttcggggagatgttgggcaccaactttttttaaagccccgtgggtggttctccgggatctcccagaccgagagggcctgaacgtccagacctcagggaatggggtcgaaggggcggcgctcgtccgcggaggtgggcgggagcggcccggggcctccggcctctagggagcgggagtgaccctcggtttctggcctccgaggggcgggagcgatcctcagccatgtccctagcctctggcttccggctgatttttaaatttttggtagaggcgggaatcttgctctgttgcccaggctggtctcgaacttgtggcctcaagcgatcctccctcctcggtctcccgaagtgcggggattacagacagagccactgcgcacggccgtggtcagctttgaaagctgggtagatccctttggctcatacgcctttctgctagcttaccctgattctgcttctggttcagatagtattttaatatttctagtgtgtctttttgtaagatacctgaaatctttttgtggaatgaagtggcatgaaaaataaaccaataatcattagtaattatgtttcctgccttttcactttattaaaatcttcgtcttgtgcatcatgtttaacaattttgagttattttagtaaatttgcaagggttcggtcccattttattgatatttgggttgtttcctatttttgctcttaataacaccgtacagaacatatttgtgaccataactttctctttaggattattttttttagatgtatgccccagacgtggcctttattggcttgcagggaatgaacatcatacctcctagacttatttttttaaagttatgctgttttagtcctgggttagttacctaattttgtttggtttgagacggagtttcgctcttgttgcccaggctggagtggaatggcgggatctcggctcaccgcaacgtctgcctccagggttcaagagattctcccgcggagcttacagtgagcggagatggcgccacttcactccagcctgggcaacagagcaagactatattgctttaatttactctgccggctatctggagagatgcaacctcatcagcagaaattatttccacctgctgctttttaaatgttatttcctatagccaggtactgagcccttcaattgaggtctaaaccctccaccctctccctccgggattgccaagcctgtggtttcagttccatgctcccaggtagattatgtcaactcaaagtcaatgcgcttatgaaatactttttgtggtttttttcttaattttaagaggttttttttttaaatatgtttttgtttcatggaggcgacaccctctgtctctgagttgtgggagccttcctccttcagtctgcatgtactgaagccactgtttgccgtacagcccctcagccgcagcagcccacagtgaggtgcaggtgctcacgccatcgccccagagagctcctccattcgcccctccacccgtagcccctcgaaaccactgccctgctccccgacacggtacactgtcttctccaagatgtcatgtgttggcatccttcggcctgtggccaccgaaactagcttccttcaccgggcatgtagcctgggagacctggggcatttgggtgcatctttccactgctggttggtgtcccctatgtggaagcatccgcgttggttcacgccttctcctgctcctgccgatggacattttgttttcttccagttattggcaatgaggaatgaggcctaaacacttgtgtgcaggtttgtgtgtgcacgtttaagttttcccttgggggacatttcagcagtggggttgctggatgacatggtaaggatgtgcttaacttcttaagaaactcccggaccactttccagcatggcgggacccctcccattcccactgcagcttatgagggtcccagttcctctgcatcatcactagaacctgggttggcccatgggttttgtctgtttttagccattttaatggatttgcagaggtactgctgactggcatttctccagcatctctatgatgttgagcctctttctcgggcaatatgccctccttataccttctttcatgaggcctccattccaatattggccctctctttaatactggggtttttactttcttatggttaagttttgatggttcttcatatatcctgcgtgccagtaggttgtgagacgtgtgattcacaaatgtttatttctagaccatagtttgtgtttcattctctttggatttttatattgctttatagaattataattttaaatttatgactacatttaatttgtcaatcttatgaatcatgcttttggtgtcatgtctaagaacttttcgcctaaccccaggccatacgaattttcccctgtgtttttacctaagggtttgatagcgttaggttctccatttaggcctttaataaatgttgtgtaacattttgtgaccgccatggccatacctttctccatctctcacggtatcgtgggcatttgcagctcccagtgcgccgtgctgttcccgtcttcttggtctgctcctcctgtcatacctttctccgtctctcacagtatcgtgggcgtttgcagctcccagtgccccgtgctgttcctggcttcttggtccgctcttcctgtgagttccagggcacgtcttagtgctggcactgtcctggtccatcgggggtcccatgagcttctccatgtgggaaggttgggactgtgatgttgacgggatgccctgtgagtcaggaggaggtgctgacgggggtttccatgtaggagagagaggtgtttggtattccggatggggcagacttgagaggggacaaacttgagaaatgccaccaatgagaagtgcaggcacagcaggtctcggggctgcccagccgtgtgggagccaaacgtggatgtgtcagtggccacaccaggaggtaaaccctcaaccaagggcctctgggtgtccaagaccaagtcttgctcaagaggtgtgttcagctgagccaaccatggcagaaatgcataagggagatcccacggttcctctgtttaaatcccctgctaatcccaccagactcagagaagcagccaagtcctcacagcagcctgcaacccccgcctgactcggcctcctcttggctctgattctctgtacccttctatccctgtctcttcttccatcagagaggagatccggcacgtttatcctggtggattcaaacccatctttgccccatatatagtcaccggaatgaataggtataatctagaaagagtccttttgaaaaagaaaaaagcaggccgggcatggtggctcatgcctataaccctgcagggaccagccccacagggtcggtgggtctctccctgtgtgcggcgatgagagagtgtagaaataaagacacaagacaaagagataagagaaagggcagctgggcccgggggaccactaccaccaatgcacggagaacagtagtgccccgaatgtctggctgcgctgttatttattggatacaaggcagaaggggcagggtaaagaatgtgagtcacctccaatgataggtaaggtcacgtgggtcacgtgtccactggacagggggcccttccctgcctggcagccgaggcagagagggagaggagacagagagaaagacagcttatgccattatttccgcatatcagggactattagtatttttactaatttactactgctatctagaaggcagagccaggtgtacaggatgaaacatgaaggcggactaggagcgtgaccactgaagcacagcatcacagggagacggttaggcctccggataactgcaggcgagcctgcctgatgtcaggccctccacaagaggaggaggagcagagtcttctctaaactcccctggggaaagggagaccgccccccccttctttcccggtctgctaagtatcgggtgttgttccttgacaccttttgctaccgctggaccacgatccacctggtaacgggcgtcttcacagacgctggcatcaccgctagaccaaggagccctctggtggcccggtccgggcataacagaaggttcgcactcttgtcttctggtcacacctcactatgtcccctcagctcctatctctgtatggcctggtttttcctaggctacgattatagagcaaggattatcataatattggaataaaaagtaattgctacaaactaatgattaatgatattcatatataatcatatctaagatctatatctggtataactattcttgttttatattttattatactggaacagctcgtgtcctctgtctcttgcctcggtgcctgggtggcttgccacccacataatcccagcactttgggaggctgaggtgggagaatcacctgaggtcagaagtttcagaccagcctggacaacatggtgaaaccccatctgtagtaaacatataaaaattagctgggcgtggtggtgcgtgcctgtaatcccagccacttgggaggctgaggcaggagaatcatttgaacccagaagatggaggttgcagtgagctgagatcgcgccactgcactccagcctgggtggcagagtgatattctgtctcaaaaacatagtaataggaataataaaggaaaagtgcaaaaattcaaacaacttaacagaaactgggcaaaagagctgaaccggccctccacagaagaggaaatgtggaggaatggctaatgaaaacatgaagaggggctcagcctaacagggggagatatcatgtgacacccaccagacgggcaaaaatcccaccacccaatccatgcaggtgttggggagaatggagagaagcaggaacaccaggcactgctaagaacgcttgtgaagtatatttctgctatgcttgtatatgaaagagtgtgtgttgtgggttatgaggaaaattacatttcttacctgggatgaaattttaaaacttgaaagctactgaccagaagaaacttgcacttgtgtacaaaagaaacgcccaagaacgttcccaacaaaacacagtcctaagggccccaacctggccaaaccctcatccacgggaagatgaagacatttcccatgctcccctcagacgacgggagaccatgcagcaatgaaaatgagccatgtcagtgtgggtgggtctcagggagagaatggaggacaaaaatagacacagagcaggtgctcagagccatgcagtgcaggagcagccacgcaggagaattccctcacgtcaaagttcaaaactacagccgaggcaacagagcaagaccctgcctcaaaaagaaaacagaaagttcaaaaactaaatggcttattttttagggatgtacacacacggtgaaagaaatgtactatgaaggaaagtgtgcaaataataaagactaaggcaagaagtgattccctccgtaggagaagggaagggactgggactcaggcagggcctccagggagcatccaaagctatgtctcttcagattctcctccctaaacttggtggaggtcctctgtgtccaatgtgtcaatattctttataccttacccatactgtacaaatgctttatttctattcaatatttagaagacagttataaacaggatgcattcaatagcaaggtggcagatgaacatcaggaaggaacatccatgagcttccatccacggaacctcaccatggatacgcttgtgatcaagggcctggtctcccctcaagacacggtcacagatcagaggccacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgacgtgccaggcgccatgttggagggctggtggtagcggcttggggaggtgctcactctgtcggtctcactctctcacacgcttcccctggctcccttcgttcccccccaccccacttggcctgcgtgctggagggtgtgcgagggagtgggaggacgtcggggggtggggggaggcgttccggtccccaagagacccgcggagggaggcggaggctgtgagggactccgggaagccatggacgtcgacaggctccaggaggcactggaagattttgagaagaggcgaaaaagaaagtctgtcctgtcctggatcagctcctttgtcatgtagccaagactggagaaacagattccgtggtcccaatttaaaggctattttattttcaaactggagaaagtgatggatgatttcagaacttcagctcctgtgccaagaggtcctcccaaccctaatgtcgaatatattccctttgatgcaacaaagggaagaatactgaaaactgtcactggatttaaccgtatcccttttactattcagcgactattgaattgttaacagatccaaggagaaactatacaggaacagacaaatttctcagaggagtagaaaagaacgtgatggttgttagctgtgtttatccttcttcagagaaaaacaattccaatagtttaaatcgaatgaatggtgtgatgtttcctggaaatgcaccaagctatactgagaggtctaatataaatgggcctgggacacccaggccacgtaatcgaccaaaggtttctctgtcagcccccatgacaacaaatgggtggcctgatagcacagacagcaaagaggcaaatttgcagcaaaatgaagagaaaactcacagtgactcttcgacatctgaatcagaagtttcctcagtgagccctttgagaaataaacatccagatgaagatgctgtggaagctgaggggcatgaggtaaaaagactcaggtttgacaaaaaggcgaagtcggagaaatagccagtcaagcgacttgcagcgaaatttcttcagttgtggtagaagaaacagaagcatcaccttcatcccatgataaagacaaagaaagccgtggtacccggcagcgcgttcagaagaggatgaagaagatgaagaggaagaagaagggattgagagaccatctgtaaaagggaggagtaaggagatcctcaaattcttgcattcattgttttcgtgaaagaactgtacatcatggaactccttgtaatgccgacgctgggcttttctcccacctgtatgcagttgctgctgaatttcaggggatgtgatttgaactacagaacatcagaattcatgaaacttaactgtggaggtattttgaaaataaaatttaagtacaacaacatttgcttagttttagagtcttttatgacatcaagagaaatgatcccagaaagaaataaacaagaaaaagaatctgatgatgcctcaactgtgaatgaagagacttctgaggaaaataatgaaatggaggaatctgatgtgtctcaagctgagaaagatttactacattctgaaggtagtgaaaacgaaggccctgaaagtagtggttcttctgactgccgtgaaacagaagaattagtaggatccaattccagtaaaactggagagattctttcagaatcatccatggaaaatgatgacgaagccacagaagtcaccgatgaaccaatggaacaagactatttagaaacatttacatgcagtattttacacacagttctggttttaacaccgtataaaacttttatgttaaaacgcgcacctttagttttacaagaaaagcaggttgtaaaataaagtactttatggataattcctgaaagagttgtccatgtaagaactgtgaatatcagctcctctgggtcctgcttacgttaccactgatttctttctttctttctttctttctttctttttttggtctgggcaaatcagtggtttgtatatagattttttttaaaaatttaggattaaagtttttaaactggaaagtaattataattttgaacagttttttgagattatcacatttagtttatacatatgcaagaagctttttgtcttgtgtctttctgatagctctagcagttttcatattttggtcatagtttcaacattttaacatgtgaataatagggtttcatgctggtttccagattgtattgttcggctacatacaatggaaccttaagttgtgtatatatatatatattattctaagggggaaaatgttatatttttctgtttgtataagagatgaatacagtggatactttttctattggtaatgactgagttcacctctttcagaagacattttctttctcttctgagtaactgaaataaaatctggcctttgtgaaaccctggaaataccacgaccctcaactagaaacaccaataccagctcctccgtgagttcccagctccacaacctaagacatcagaggcagcattggttcctcacgtagattccagctccgggacccccatatttgaaccgcaagaccatctcatccctggatctccagctgcaccacactcaaattagaacaacatcagctcctccccaggtctccacctgcacagccctcaaacgggaacgtcagctcctccccgggtctccagctgcagggccctaaaactagaacatcagctcccgcctgggtcgctagctgcaccaccctcaaactggaacatcagatccccatgggtctccagctgcagggccctcaaactggaacatcagctccccaccagatctccagctgcatggacctcaaactggaacatcagcaacccgccgggtctccagctgcactgcctgcaaactggaacatgagctccctgccgggtctccagctgcttggccctcaaactggagcatcagctccccaccagatctccaggtgcatggccctcaaactggaatatcagttccaccctggggctccaggtgcacagccctcaacctgcaacatcagctctccactgggactccagatgcacggccctcaaactggaacatcagctccctgccgggtctccagatgcacggcctgcaaactggaacatcagctcccgtcaggtctccagctgcacggccctcaaactggaatatcagctccaccccggggctccaggtgcacagccctcaaactgcaacatcagctctcagccaggtacccagctgcatggccctcaaactgcaacatcagttcccccccgggtctccagcttcacggccctcaaactggaacatcagctccccaaccaggtctccagctccacggccctcaacctgcaacatcagctccccaccagatctccagatgcacggccctcaaactggaacatcggctccccacagggtctccagctgcatggacttaaactggaacatcagctcccaggccctcaaacaggaacatcagctcccaggccctcaaacaggaacatcagctccccacagggtctccagctgcatggccctcaaattgcaacatcagttccccgctgggtctccagctgcaccgcttcaaactgcaacatcagttcccccctgggtctccagctgcaccacttcaaactgcaacatcagctccccgctgggtctccagcagcatggccctcaacctggaacatcagctcccccgaacccgggtctccagctccacagccctcaacctggaacatcagctccccccaacccgggtctccagctccacggccctcaaactggaacatcagctccctgccgggtatccagttgcacggccctcaaactggaacatcagctccccaccaggtctccagctgcacggccctcacactggaacatcagctccccaccagatctccagctgcacggctctcaaacaggaacatcagctccccacagggtctccagctgcacggccctcaaactgcaacatcggttcccccctgggtctccagctacaccgcgtcaacctggaacttcagctcccccccgggtctccagctccatggccctcaacctgcaacactggctccccaccgggtctccagatgcacagccctcaaactggaacatcaactccccaccgggtatacagctgcatggccttaaactggaacatcagctccctgcccaggtctccacatgcacagccctcaaactggaacatcagctccccgccaggtctccaggagcacggacctcaaactggaacatcagctccctgccaggtcaccagctgcatggccctcaaactgggacatcacctccccacgaggtctccagctgcatggccctcaaattgcaacatcagctcccatcagagtctccagctgcatggccatcaaactggaacatcagctccccggccctcaaaccggaacatcagctccccgccggatctccagctgcacagccgtcaacatcagctcctccccgagtcctcagctgcacgaccctcaagttagaacatcagcttctccccaagtcttcagctgcgtgaccctcaatctagaacatcagttcttctctgggtctgcagctgcaagaccctgaaactacatcagcttctctccagttctgcagctgcaagaccctcaaactacaacatcagcttccctccaggtctccagttccatgaccctaaatctagaacatcagctccttcctgagtctccaactgaaagaccctcaaagcgaacaacatcagttcctccccgagtcttcagctgcacgacactcaatctacaacatcagctcctgtctggttctccagctgcacgaccctcaaactacaacctcagctcttccccgagtcttctgctgcatgaccctcaatctagaacataagctcctctctgggtgtccacctgtagggacctcaaattagaacgtcagctcctcccagagtcttcagctgcatgaccctcaatctttaacatcagctcctctccaggtctgcagctccatgaccctaaaaatacatgagcagctcctccctgaatcttcagctgtacgaccctcaaactacaacatcagctcctgtctgcacctccagctgcagagccctcaaactagaatatcagctcctccccgagtcttcagctgcacgaccctcaaactagaacatcagctcctgtacagatttccaactgtagggccctcaaactagaacatcagctcctccccgagtcggcagctgcaagaccctcaaattaccaactcagctcctcccggagtcttcagctgcatgaccctcaatctcgaacatcagatactctctgggtctgcagctgtagggccctcaatctagaacatcagctcctcccgagtcttcagctgcatgactctcaaactagaacctcagctcctccccgagtcttcagctgcacgacccttaatctagaacctcagctcctcccgagtcttcagctgcacgaccctcaatctagaacatcagctcctctccaggtttgcagaagaccctcaaactagaacatcagcttctccctgagtcttcacctgcatgaccctcaatctagaacatcagctcctctgcaggtttgcagctgcaagaccctcaaactacaacatcagctcctctccaggtctgcagctgcaagaccctcaaactggaacatcagctcctctccaggtctgcagctgcaagaccctcaaactagaacatcagctcctccctgagtcttcacctgcatgaccctcaatctagaacatcagctcctctccaggtctgcagctgcaagaccttcaaactagaacatcagctcctctccaggtctgcagctgcaagaccctcaaactagaacatcagctcctgcccgagtcttcagcagcatgaccctcaatctagaacatcagctcctctctggatctgcagctgcaagaccctgaaactagaacatcatcttctctccaggtctccagttccgtgactctaaatctagaacatcagctcctccctgagtctccaactgaaagaccctcaacgcgaaaaacatcatctcctccccaagtctgcagctgcaagaccctcaaactagaacatcagctcctccccaggtctgcagctgcacgaccctcaatctagaacatcagctccaccccaggtcttcagctgcacgaccctcaaactagaacatcagctcctccctgggtctgcagctggaagatccactaactagaacatcaactcctgtctgggtctccagctccatgaccctcaatcaagattatcagctcctccctgaatcaccagctgaaagaccctcaatgtgaacaacatcagctcctccccgagtcctcaactgcaccaccctcaaactacaacaccagctcctccccgagtcttcagctgcaggaccctcaatctagaacatcagctcctccccgagtcttcagctgcacgaccctcaatctagaacatcagctcctctccgcgtctgcagctagaagatccactaactagaacattagctcctgtccaggtctccagctccatgaccctcaatcaagattatcagctcctccctgagtctctagctgaaaggctctcaatgcaaacaacattagctcctccccaagtcctcaacagtgcgaccctcaaactagaccatcagctcctccccgagtcttcagctgcacgaccctcaatctagaacatcagctcctctccaggtctgcagctgcaagaacctaaaagtagaacatcacctactccctgggtctgcagctggaagatccactaactagaacatcagctcctgtccgggtctccagctccatgaccctcaatcaagattatcagctcctccctgaatctccacctgaaagaccctcaacgagaacaacatcagctcctccctgagtcctcaactgcatgaccctcaaactacaatatgagctcctcgccgagtcttcagctgcacgaccctcaatctagaacatcagctcctctccgtgtctgcagctagaagatccactaactagcacattagctcctgtccgggtctccagctccatgacccacagtcaagattatcagctcctccctgagtctccagctgaaagactctcaacgcaaacaacattagctcctccccgagtcttcaacagcgcgaccctcaaactacaacttcagctcctccccgagttcagctgcacgaccctcaatctagaacatcagctcctctccgcgtctgcagctgcaagaacctaagagtagaacatcagctcctccccgagtctccacctgaaagaccctcaatgagaacaacatcagctcctccccgagtcctccactgcatgaccctaaaactacaacatcagctcctcgccgagtcttcagctacatgaccctcaatctagaacatcagctcctctccaggtctgcagctgcaagaacataaaagtagaacatcatctcctccctgggtctgcaactggaagatccactaactagaatatcagctcctgtccgggactccagctccatgaccctcagtcaagattatcagctcctccctgagtctccacctgaaagaccctcaatgcgaacaacatcagctcctccctgagtcttcagctgcacgaccctcaatctagaacatcagctcctccctgagtcttcagctgcaacaatctaaaactagaacatgagctcctccctgagtctccagctgaaagaccctcaacgtgaacatcagctcctccccgagtcctcaacagcgcgaccctcaaactacaacatcagctcctccccgagtcttcagctgcatgaccctcaatctagaacatcagctcctctccgggtctgcagctgcaagaacctaaaactagaacatcagctcctccctgggtctgcagctggaagatccactaactagaacatcagctcctgtccgggtctccagctccatgaccctcattcaagattatcagctcctccaagtctccagtgaaagaccctcaacgcgaacaacatcagctccaccccgagtcctcaactgcacgaccctcaaactacaacatcagctcctccccgagtcttcagctgcatgaccctcaatctagaacatcagctcctctccggatctgcagctgcaagaccctcaaactagaacatcagctcctctccgggtctgcagctgcagggccctgaaggtagagcatcagctgctccccgagctagaacacctgtcccacctggatctccagctccacgaccctcacagaagaacagccacactggctccttcattgtcttcagctccacaacctaagacatcagtggcagcaccggctcctccctggacgtccagctcaacgactctcatagacttaaaaggcagcacctgctcctccccaaggctccaactccaccaccctcggatttgaacagcggtagcaccacctcctctccaggtcttcagccccacgtccctccctgaacaatcccttcttgtgaaattcagcagtcaagaaatctgcagcgaaagtaaatgaataaatgttttgttttcaagtctatgtctcttttatgttcaggcaagtcagttaactattctactttccattaatcttgcaatctacttatgtccaatgtgagatagaaacacaccatttgaaaacacgtttaaaaacttagtaatttttaaagtatgatcacacagctgtagatacgatcttatttctctctgcctgtgcagaagtcttatgaaaattcaaactgaatttaccatgttgagattcccagaatacacattaatcccaaatgttactcccctccttaaaatcttttaacatattcccatcacccgagcataaatgccagctcccatccacagcccaaagtgcccagcacggccctgccctctgccctcgcctatggtctcctctctggtgcccggcccggccctctccacccctctgccctggcctatgttctcccctcttaaatgccagctcccatccacagcccaaagtgcccagcacggccctgccctctgccctggcctatggtctcccctcttaaatgccagcaccatccacagcccacagtgcccagcacggccctgccctctgccctgccctctgctctggcctaaggtctctcccctgtgccgttcccttcctgacggacaggcctctgtccgttcctcaaaccacacaggctcaggcctgactccaggcctttgcacttctgtaccctctgcctagggtgcctttcccgggctctgcatcctcctctcaacccgctgagctccagcctgctggtcgcccctcaggtggatgaacacacggtgtcctctcgccccaccagcttttgcacaggctcttctctgtgccagacacacaccctctctatcggggtttactctctaaataccattcatccttggagtctccactgaaatatcgctccctgcccacccccctcacttggacttaaccttggttaggttgccaacccccgtctcctgactccgggaagctagatgctctcctagcactcggaacttgcccatcgccacatttgcacacccgtggttactgggttaggttggggcacaagtcatcgcgggttttgccattactattcatgaactgcagcaccggctcctccccgtttcttttgtgtttttttgtcattacttttaatgactgctgcaccaacctgttagaatcatttatatttatccatccatcatctgccttcccctctagaaaggaagctccatgagaatagaggccaaatctactcaaatcactccaccttcccagcacattgtttgtcaataatcatttacaaactgactgatagagaaatgccttccctgttgctgggatgaggcacatgacatgcccctttgaaagtcaattccatggacagttagcatttgctcttcactcctgcacccatggcgtggctgggcttaggctgatctagtctggccttgactccaggctaaggatgggaaccatgcctgctccacacgcctctcatcccacagccagagccgccgttccctggggcacgtgcatctcgtggggaaaatcaagagccttagagggcaggcctggcagtgcccacacattccaggcttctgtttgtgccgtgtctgtgaaaatctcgttggcagaagcaagtcacccagccacgagcaacacctatgggatggataagtccatccaccctccctcaggccctggcaaggttgtggctatgtcatactcttacggggggagtgaaaaattgaggcccaacattaaatcacccaggcaagaaatgtcagcctctgtccccacgctggaatcatttttcaccagcgggtttgcctgaattccctttgcaatggtgtctgcaggtttaggccaatgctggtccccgtggaggacacagaagcctcaatgggcctccgtctgttgggaagaacaagataccagcttggtgcaaaaccaccgcaagccccagggggcccttgcgccatgaaacaggagaggggcagagaactgtgggagctcaggaaagcttgcgtccccagcccctcccctgcgtccccagccccctccccagcatgcccccatctctgcttcctttctttctttccttctctttctttctttccttctctctttctttctccctttctttctctctttctttctttctttttcttttccttccttccttccttccttccttccttccttccttccttctttctctttctttttcagggtcgggctctgtcatccaggctggaatgcaatggcgtgatctcggcttactgcaaccttcacctcctgggctcaatcaatcccccttcctcagcctccccagtggctgggactacaggtgcacgtcaccacacccagctaattttttttttttagagacaggattttgctatgttgcccaggctggtctcgaactcctgagctcgagcaatcctcccacctcagcctctcaaagtgttggaattacaggcgtgagccactgagtccagcctgctttatttttctttacagtacttggaaccttcttttttttttttttttttttttgagacggagtctcactctgtctcccaagctggagtgcagtggcgcgatctcggctcactgcaacctctgcctccctggttcaagcaattctcctgccttagcctcccgagtacctgggactacaggcatgtgccaccacctccagctgcaccttgatctcagagacttctggcctccagaaccatgagacaataggtttctgttgttgaagccccagtctctggaacgctgttaagtagccccaggaagctggcacagaacccggccggccctcctgggcgagctgctttctgccaggctctgggggtggcgggtggcctttcagtgatctcctccagcacttgaccctgttctgacttgtattttgggagtgtcttttgtcttcctaatgttgatagcctcacacacgtggcattgtactggcacccgagaaccagcactcatgtatgtagcactttcagaaattagttatatttatgcatggtcatggtcatactcataaatctaattggacttcttttttaagaaagtgaaacaaagcctgaattctccattgtcgtgtcggcctcagttcccggagctgtcctgtaagttccttgaaaacaggtgcacccaacctgtacgtgggacctctcaacagctgcctcatagcctgggccctggacagctctgaagtcagaggagtggggcttcagtaggttgcgctggggttaaatcctggccattacccacaaggaaagaccaatgcagcagaaccgtccctgaagcagcgaaacgtggtcaggagccgtccgtcagtgagagccatccctttggaagttcttcacaggacgatacgtcttagaatttttaacacatagtgatgtgccacgaggtggctttcccgcctcattcctactgacatacgtttatattcaaagtagaaacagaaatcgtcttctacataacaaagtcctgaaaatcgtcacagctcttaagccacgtggttcctcagcaccacctgagctgacccgtcccagctcgtgatcacacagacaaagacataactgtagaagcgtcggtatttcatatgtatcaaatttcatttttaaaagacatttttaggggacagaaatgttatagaacaacttttaacgttccacaaaagtataaatagtagaaaaggaaactagtgcgtgtgaactaggactccatgaaaagtacccagtagttgaagctccacgactccatggacagaagtttgcataaatatttaagcgatgttagttcctgaacatataagcaagccgtggcaggtctgtggccagagccctctggagtccttgctgggaaggcgcagctcagggggctcctgttactggttgaggaggggagacatgccactcacctctcccagggagcccccggccacggactctggcaagaacaatggggcagaacataaggagcagtggccaggcagcaggtgcacctgcgtcccctcccgcatcccccctgcatcccctgcccgcatcgaggcagcagggtccacaagctctcaggggccacgtgcaggacactccaggaaggaccacacagcctgagctgggggccacagagagaggacttaaggggaagggcagacaccccacccctccccacaccctgccccctgccctctgccccctgcccccggcaatcacctgggtctgtggcagcagctgtggggacaatggcagagggcaggacccagccccgtgggggaacttcctctccatgtggggctccagcaggatggggccagacccactgcttctttctcccacgtcttcccagcccttggcccaggcctgccacagccatgggagtgcacagctcagcaggtaactaaatccccggctttctagctagagaatgaaaatgagggttcccagggagaaaggacattttagggagattcgggagagggagagtcttggtaagtggcgtgtggcctcctgggctgccctgagctgttcacatgtggatttgagctcatgggcagacctcagcctagaccctggcggtgcacacactgggcacatgcaaacagcattgaaggctttgagaaaggaactggctggggaaacccagaccacaaaatgttagttgaaacttacagcctgaatttaatcgggttaatgctcactaaaacaaaccaatacaaaatcaacattcttcattggagtgaaataagatgcagagtctcctaacgtaatattcatggtgtccagaatgcaattcaaccttactaggatatgaagaaccaggaaaatggcaactcacgcaggaaccagccagcccatgcccgtaccaagatgactgagatgttgtgatccgctggcaaaaaacatgaaaatagctgtgataaaaccactgcagccctagtcacaaacactcttgaaacaaatgagaaaggagaaaatctcaggaaggaactagaagatgtaaatataaaccaaatggacatcttagaatggaggggcaataagttctttttgaaaaaaacctcactggatgggattatagaagacagtaaagaaatatcagaatggaacaaagagtctgtggatttgaatataggttaatggaaattatccaatcttaacaacagagaaaaacatgagaaaggaatgttttaaatgagaatatcttctcgtggagactcagtgcgcagacctagcttgtaactctcctgccactggaggggcaggtgaaggagacctacatgaagatggattcacaaattccaactagcaaatatgggttccaggcaaagtgtgaaaagttaactatgtacattttatttcctagacagtgatgcactgtgtaaaattaaatcaccccaaatataatgatagagatagaatgaaaatcaaaaggcaaaaagtgaagcaaacaccatgcaaaccctcatcgaagacagtgggataagccacgttagtatcaggcaaagtaggctttgaagcaaacaaaatcaccagggataaagagaagaaaaaaataatgacaaaagggtcaagaaaacaacaatcctaaatgtgaattcaccaaatgccagaactctaaaatacttgaaacaaaaatttaaaaacccaaaaagagaaatagacgaagtccacagtgaggtggtaacactgctctattaataaagattatactaaaaagatagaaagttctcaataatgtaggtttcgactttttaaaaggtagaaaaaggaaaccaaaatgaatcaaaaccaagcaggaggagggaaataataaaggtaagatcaaaaaacaacaaaattattttaaaatacaatagaaaaatgaatgacaccaaacctaattctttgattaaatttgaataaaattggtgaacttctaacaataccattgaataaaaaaggaaaggagggagacacagtttaccaacattgaaaaagaaaaatgggtcatcattatagacactgcagacactaagggataaacagggaataatatgacaactccatacacatgaactcaacactcaggtaaaatggacggattcttcagaaaacacaaactcaccccatgtgaaagcaataccctcagagggttatttgtattcccaaaccttttaacaaagaaatctccaggcccatttttttggctaagaaattctaataaatatttcacaaagaaatgccatcagttctacataatgtcttcaaaaaacagaagaggaggactccccaaattatttaatgagggcaagtcatcaggataccaaatgcagacaaagagcattcaaataaagaaagctacagatcaatactcttcatgaatatagacataacagtcctcattaaaatgttaccaaattaaatctggcaataaacaaaaagagtaaagaataccatgctagagtccaaatggtgctatttactccaggaatacaagggtggtttgatagcttaaaaagtaaaatcaactaatgcaatacatcatattaacagtttaaagaataaaaatgacatgataatatcaattgatgccaaaaggcagttgacaaagcaatatcaatttatgataaaaactcagccacaaagataagaggagaacttctccaacctgaacagggcatcagcagaaggtctatggctggcatcacactcaacagtgagggactcatgctttctcagtgagatcaggcagaagataggaatgcccagattttctaatcctattggacatcacacttaaaatcccagtcagtacaaggcaagaaaaagaaataaaatgcatattgattggagagaaaacagcagtgtccttagttgtagatgacatgattttacacacagaaaatcccaagaaacacaaaaacaaaataaataaataactctcagaaataatgaatgaatttagcaaagtagaatttatgatcaacaaatcatatttctacatttacatagaaagccaatcatatttttccataatagcaatgtataattggagactcaattttttaaaaaatgcctttgtataacaggtccaaacaatgaaacatttaggtatgaatctttccaaacatgtacaggatctccaagttactacaaaagacctatgaagacaatttttgcatatatgtatgtatgtataaataaatggagaaacaacatgttcatagattgaaagacccaacatggtaaatacatcagctctccccaaattgatctgtagtttaatgcaattccaattaaaatcccacaaaaatgtttaaaccgagctgattctaaactttatatggaaaggcaaaagacagagaatatgcaacttgatactgaagaagaacaaagttggagaaaacataaaattaaaactactttattttaagacttactataaatctgcagtcatcaagacggtggcatttgcagagtagcaaacgtatagatccttgaaacagaatacagtgtccagaacacaaacatgccaaatatgcaaaaggagtcatggagggaaggagtctttccaacaaacggttatgaatcatgttgacgggcatgtgcaaatatctgcaatctaaacctcacatcttatgaatacttaactgaaattaatcacagatctaaaatgaaaactacaaaagtgtaaacattttagaagaaaacataaggagaactcttcatgacctattattaggcaaagagtttactataatcaggttaaaaaattgatgtactccacaaaatgtttaaaattaaactttgtactaaacgatatctcaattcaattgcaccctggtaaaaagccaagtctacctggacatctcagaatcctctgcaccaatgtggaaggatgctggcttcccacacctgctgtagtcagttaccagaaacccaggggcttaaagcaatcgaagtttcttctctcacagctctggaggcatgaagtccaaaaccaaggtatgggcagggcctgctccagtcaaggcctctcaggtctgtggggtgtggcgggcggaggaggcacctctgggacggttgccacatcagtcacagcagaagcacccgtgcttcccccagcatcttgaagaaagctgaggaggagcagtcagcagctgtgccctgtctgttttagcaggagcctgaataaaggcacaggtggctgcagctgcgtccaatgccaccaaatggggcctttgtgagccatggacataccgaaggacctcagcatcttcaaagccctcagacgtggcagaaaaccagttgggaggaatatttgctcccgcaccgacgcgcaaacagcctgacgtgtgtgaatacagagaccggggggttccttccgaaggctgtttaaattcccatcgtgttttcaatgggcattcatttagcagtcttggctttatgaatcataaaaataaatgctctgtttgtttttgtccctcaaacgcactcagttaacctgctcctgtccccagaaggcgattaacaaacacttaaactgctggtcagcttggtcattactccaaccctgcatgacgatggaaccatcaacacaacttactttgatattttttcctccccaagcaccagctcagaggaggccagcaggcccgggccccaggagcttcacctcctcctgatgcgatgtgtgactctgggaccccctcacactcctggccctgcagccccttcccctgcatgccccctcctgtgagagtctcagtgactgtccaagagcacacctggccttgtctctccatgaccttctcctgggctcagaccaacacaaggagagccaggatggagagttcaggcctcagcttcccctcagtgtggccccagggcctcgggtggtgattgcccaagcctcctcaagtgtggtgggcgggtattgctgctggtgttgaggtggggggggtgttggagtggatgggtgttgatgggtgttgtggtgggggagtgttgacttgagtgttgtggtgggcaggtgttgtggtgggcgggtgtggactcaggtgttgtggtgggcaggtgttgtggtgggcgggtgtggactcaggtgttgtggtgggcgggtgttgtggtgggcgggtgtggactcaggtattctggtgggtgggtgttgacttgggtgttgtggtgggcgggtgttgtggtgggcaggtgtgcactcaggtgttgtggagggcgggtattgccacgggtttgtcacctcttcctgtcccaggaaagtgctggttcccaagagcactcccaggtaatgggttgaggttttccactatgggccccagcaccagttctgggccccaggaaattctctgtggacgctgtgctcttaccccgtgcatggacattgagctattggtaggtctttacaaacaatcctgggtccactattctgagaggagctgaactcctgtgtgagacaccacatcggaaacaccagggccaaaagcacagatggagtcttcctttgcttccccaaaggaagaatgcacaggagcctggcactcctggacctgaggaaaccctgaaatgttggcatctgcagatcctctccaaaaagaggtcaccagtctcctaactgcaagtctgaccccagcattctgggagccaagagggagaaagagtctgtggatctccctgctcagtaaattggctttcactaaatcctctctgtgcataagcagcattacccagtgtcctggagcttagaaaagtcctgtttcaatgtctgaagaaaataaattgtttctttttccaaagtcagggaggagtatttgactgccagtgtggactgaggggtcttgggatcacactcttcccaatcagctttgaaccgaccctctgtgtctgcctcaccatctcctctgcttatctagacacttgggaaccctaacacaagcccttctaggagtctgtggtgtggctcagctgcctctgtaggcatgtctcttcccaatgtgctttgaaccgacctttctgtgtctgcctcaccatctcctctccttacctagacacttgagaaccctaacacaaatccttctaggagtctgtggtgtggctcagctgcctctgtaggcatctcttggggttaaacattttccactctgctaaggcagtgccatctattcttctgcttcatcttcagaagacactgagcccttccccaccctcccttccccaccccccacaccaagtccgtggcacccttgaggccacagggttgctgccataagatttttgtactgagtgttctctctccaagcaactgtgagagatttctatgggcaaggcctccgggttcctgttaaatcaaattgtagttgagtgttgggtgctattcaagaagcatccacctttctccttcctaacagagccctgagttattcagtcacatggtttgaaacatggggtgagtgctggttgacttaacctaaccagcaccgtctcaccctgtgtcacagttactggttccaaggtgggtgcataactgaggctcatgctaggtgccacacagcactcccttggtccccctaatggacttggggatgggcaagggcctgcgttgttccaattagagtcaaatacacattgtgctaagagtgtgcttgttcatgctccctctctgatgaagaatgcagcctcagaaattgttcctggagattttgccacactcagaatgattctgacttcactgaaggcagagcagaaaattgggaagagactgagtcctgggtagcatccatgagcttctgtgctcagattcaccctgaagcctggcctgcttctgaactacccacctgagtcaataaattgccttcccattaaagtcaaattgagctggatttttagttacttgcacctgcaggtgttctgtgaagctggtactgtgagtttgtatctgagaatatttacagtttctctcatggttgagtcaatcatttcaaggatgctttgagggtaaaaagaatgatcaattgtgaagcagtgaattgtgctgccaggcacaattcattgggcaatagaaagcctcatttcctgggcagtagaaagtttcattgtacattagttacatatcttgtttctgtctcaacctcctattttttcatatgcaaaggaggtaaggaagtccacataagtccagcagctaatatgcctctcaggcatgatccaaaacagaattgaattatgcaagccttgttaaaattcattgtcgtcattcatatttctgaatatttaaattagaaattctgaaaaagtagtttgtttcagaggtagtttgtgtgtatgtaggtattttttcaggatcaaaagtttattttttattgtctgattgagtttaatttacatataataaaatttagtaattttaagtgtacaaatgaatgcattttgacaaatatatatagtcatgtacacaacactaccattgaaatacatttcattaccccgaaaattcccttgcatgctgctgtagtcagtgccccctccaccacagctcctggcagttgctttctttcactctggttttgtctgagaatttgatacaggccacgtgtggtgactcatggctgtaatcctagcactagactgagaagggaggatcacttgaacaaggagtttgggtaacatagcaaaaccctgtctcaaaaaaaaatacacacacacaaaaacttagccaggtgtggtggcacacacctgtggtcccagctactcaggaggctgaagaatcacctgagcctgggaggtcaaggctgcagtgatctgtgatcacatcactgcactccggacagagtgagatgttgtcaaaaaaaaaaagaaagaaagaaagaaagaaagaaagaaagaaagaaagaaagaaagaaagaaagaaagaaagaaagaaagaaaagcatttgatataaatggaatcatacagtaaattatcttatacctggtttctttcatatattttaatgcctttgagctatgtccatgtggtttccagtgtgtatgtcattcttcttacgttgggcagtaaccactgcaggaatatattacagcttgtttatctattctgcagtgatagactattttaaaaatatttggctattaagaagaaagttgttaagaatacttatattcaggcctttgtgtaaacagattttcacttctcttggttgaaaacataggaggaattattattttttaagtcatggatttttaaatgattgtcagttactttaaaaaatgtaaattcttaaattaaaaagtttaggatgtctgacaaccctgacaaaagcaagcaatgggaaaaggattccatatttaataaatggtgttgggaaacctggctagccacatgcagaaaactgaaactggaccccttccctacaccttacacaaaaattaactcaagatggattacagacttaaatgttagacctaaaaccataaaaaccctagaagaaaacctaggcaataccattcaggacataggcatgggcaaggacttcacaactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctatccatctgacaaagggctaatatccagaatctacaatgaacttaaacaaatttacaagaaaaaaacaaccccatcaaaaagtgggcaaaggacatgaacagacacttctcagaagaagacatttatgtggctgaaaaatacatgaacaaaagctcatcatcactggtcactagagaaatgcaaatcaaaccctcagtgagataccatctcacaccagttagaatgacaatcattaaaaagtcaggaaacaacagatgctggagaggatgtggagacataggaacgattttacactgttggtgggagtgtaaatcagttcaaccattgtggaagacagtgtggcgattcctcaaggatctagaaccagaaataccatttgacccagccatcccattactgggtatatacccaaaggattataaatcattctactataaagacacacgcacacgtatgtttattgcagcactagtcacaatagcaaagaattgcaaccaacccaaatgcccatcagtgatagactagataaagaaatgtggcacatataaaccacggaatactatgcagccataaaaaaggatgagttcatgtcctttgcagggacatggatgaaaatggaaaccatcattctcagcaaactaacacaggaacagaaaaccaaacaccacacgttctcactcataagtgggaattgaacaatgagaatgtatggacacagggaggagaacatcacacactgggacctgtcagggcgggtgggggcctaggagagggatagcattaggagaaacacctaatgtagatgatgcgttgatgggtgcagcaaactaccatggcacgtgtatacctgtgtaacaaacctgcacgttctgctcatgtatcagaacttaaagtacaaaaaaaatataaaagtcacaggatgtttgtgatagtatctattacactgatgttaacatcacatggttgactatgtggagactccaagtgaaatttcttgcagttgtcagtgccaggaaaatctgtatttctggataaaactcaaagagtttagaaaaacattcaagtttcatagtctagaggtctaacactggaatcttttccaaatttaaggtttaatgattttcttaaatctaaaaatagtaggttgcagatgtatttaaacagtgtgcctaggtagtatgtttatatattaggattaaaatgctcttctaaagtttactaattctaacacagcctttattgtttcatggagacatatctttccgattcccaggttaatttaaacaattaattcaaagcaactattgacttagttctacattgggatacctatttatgcatttgaagccttagatatgtatttcaaattagaaacgtgtactggtcatggaaagttgtgactgagagtctcaggtaagttttgtttccatgtgaacacactgcttccaattaatgttatgcccagagcagacaattaataaacaccctttgaagtgaatgagtgattaactgcaaatattacaatacatcttcttagtgggcatgataattggacatatttagtccttgctgtgacctaagaaaggaattgttttcattaaatgtttaatgtttcaccctgttcatacagctggagttactgattcagtttgatgtgaattcagtcttataaaaaacccatcattataacctgcacttatgcttcctacagtatcggaacttccaacttgtaggcaaaatagatatgcttcatattcttaaaaaccacaagaaatctccctttattcagaataaacatagaattagatattctattaaactgaacaataggactcactgggagtgaccacatacactataccacgcattgcccgagtgtctgaaaaggtcactggaccatttcgctccatgctgtgccacgggccaaccacgagggctgtcagtgactcactgcgtgggccacccagggcatgtggtgctgaggctgtcgaagagcaagacgaggctgtatttaaactcaggcctctgctaagtgtcagaacttgggcaagatgccatacactttagagccagtttccttttctatgactgggttataacactcaccctgtcaggttctcgtgtgcgttgacaaggccggcatgtgacacaccaggggcagagctggacgggaaccttcttcctcagacatcagggtcctcatgagcatcaacaaaataaggagagctgtgtcaggactgcagcagggactcagcaacaatcagtctctttctcttgtttcatccaaatcatacatttaaaaaaataggtggggttatcattgatgtttatattgattactgggatcagacaaatacacctttccttgtcatgctgttttctcttcccagatggtttgaagagcttcattttggacttgatactcctggaatgcacatgagaaacagtagccaatgatttgcacatttcacagcagtgtagctcttcattcacaaactcagatagaaaaaaaaaacaaaaaaacttcttgtattttctaatgagttcagtcttgaccctgagccatctcccctccagaatggcaggacactccactccaccattgttgtggggccacaatttcactaatcaagggctccttggcttctgaaaaatgggagatgcacctctaataaccagtctagattgtcactgctcacttccttattttccaattccacaggggcccccaaagcccagaagatctcatttccaggcgtcttatagaccatgggaacctggtaacactgggaaccccggggccagcacccacctcatgttcaccctgtttccatcaccttctaggcattgctacagagcagtgttgggacccactggagatctgactgctcccagcctggaaaactgccttctctctctccactgagctcatgatatttctgctttccgccccacagaaatccttgaatgaagcacaaaagggactggtagttacctggtgtgaagcagagctgagcctatgggaggaagcaatattgcaatggactctgtcattgatgtcactagtgcacaaatctgttaccactatggtcaaatttttatattcactttaagattataactcattctgctcattgtattcaatgcaacatctaccccaaaagatactcaggctttaatttatgcttttctgtttacaaatgagaattcatcagcaaattgaggtagcaagtagatatttagatattttttaaattgaaggcaaaacagaagacacatacacatacatcagtgaaacagaacagagaacccagaaacagaatgaaatgcagccaactgatttctgacaaaggagcaaaagcaattcaatggagaaaggagagtctttttaacaaatggttctggaacaagtgggcatccacatgcaaaaaaaaaaagaatatgtaacagaccttatactttttacaaaagttaatgcaaagtagatattagaccaatatatgaaatgtaaaattttcaaacttctagaagataacataaggaaaaaaaatctagataactttggatttggtgttttttttttcagatacaacaccaaaagcatgatccacaaagaaaaaaattgggaagtttaatttcattaacatgaaaaacttttgttttcaaaagatactgttaagagaataaaaagataaatcacagactgcgagaaaatatttgcaaaatatatctaaggattcatatctgaaatacacaaagaactcttaaaactcaacaatgagaaaacaaacaaaactgggcaaaagctgaacaaatctgcagatggaaactaagtatatgaaaagatgctgtgtataatatgttattaggaattgccaattaagacgcaataagataccactacacacctgttagaatggccacaatccacaagaatgaaagcaccaaatgctggtgaggatgtggagcaatgagaactctcattcattgctgtgggaatgcaaaatggcacagccactttggaagacagtttggcagtttttacaaagctcacatagtcttgtcataagatttaacaattgtgctcctcattatttacccaatggagttgaagagttatatccacacacaaacttgcacacaaatgtttatagaaatgtgggcagcaagccacccaggtgccgatgtaagagaccgagggcacgagctgttccagtgtaataaaatatgtaaaataacaagagttatactagatctagatcatagacatgattatctacgaatatcattcatcattagtttgtagcaattactctttattccaatattataataaccctcgctctataatcataacccaggaaaagccaggccatacagagataggagctgaggggacatagtgaggagtgaccagaagacaagggtgcgagccttctgttatggccggaccgggccaccagagggctccttggtctagcggtaacgccagtgcctgggaagacgcccgttgccaagcggactgtggtctagtggtagcgtcagtgtcaaggaaaaacacccgctacctagcagaccgggaaagggagtctccctttccccgggggagtttagagaagactctactcctccaccttttgtggagggcctgacatgagtcaggcccgcctgcagttatccggaggcctaaccgtctccctgtgatgctgtgcctcagtggtcacgctcctggtccgctctcatgttccactctgcacacctggctctgccttctagatagcagtagcaaattagtgaaagtattaaagtctttgatctttctgaaaagagcatagaaaaaataatggcataagctgtcctctctgtctctctgactcggctgccaaacagggaagggccccctgtctggtggacacgtgactccgtgaccttatcaatcagttggatgactcacagtctttaccctgccccttttgctttgtatccaataaataacagcgcagcctggcattcggggccactactggtctctgcgtcttggtggtagtggtcccccggtcccagctgtcttttcttttatctctttgtcttgtgtctctttttctacaatctctcatctctgcacatggggagaaaaaacccacaaaccctgtagggctggcacctacatagaagctttattcagaattaccagaaacgaggtgaccaacatgtccttcagtaggtgaattgagaaataaattctggtacctacagacaatggaatatcattcagtgagaaaagaaatgagctatcaagtcatgaaaaggcatacagggacccaaaatgcacattactaagtgaaagaagccaaaaaggctacatactgtatgattccaattatgtgacattttggaaaaggaaaaactacatagagagtaaaatatctatgtaattacgtgacattttggaaaagggaaaattacatagatagtaaaataatcagtggtcgacaggggttggggagaggaaaggatggatgggcagagagccccggatgtttagggcagtgagatcactgtgtgcgatttcaccacaacagtggacccacgacagtgtgcagatgccaacacccactgaacgcagaccacaaaaaggtattaattacataaactatgaactttcataatgaagtaaatcacgttttaaaaaagtagacagttttttttcagttattgtctactttctgaaatggagatggcggagtgcttccatggttgtgaggataaaaatagcttagagaatgtaataactaaaataggtgtgtaaacattgttaaactattttatcctcattaaatatatttgtaactttttacaactgagcgagtagtgcaaacacattaacataattctcctgtagctccactcagaagtcaggactgcagggcttcagtgcagggccacacagctccacacgcacctgccaaacgcaacagcctctttcagcgtcattaaaatatttcaacaggaggactgagtttagactcaacctgtgttttctcccctggaaaacgaaggtttcatgaagcaaggaaggtctttactgtcctcatccgaaacgctgaggcatctgtgatgtctgctgtaagtgccaccaggctctccgctgaaatctcgcaacgggaaaatagagaccgtagattctgcttttagaaaggggagaatcagaagtaatgtggaaatgccatgtcctcgttcataaacatcttcttttacaaattccacaagtttagttactttgggattaatatgggcttatcttaaagtgcgtttattaacttagcgtgagttgttcaaatgcattctggatcctgagccgacatccagcaatgctgagtgtgcgcctgtgtgagtcaccagccctgatgagcctcaggttattgtgttcgtaaaatgaaggggcttaggcttgctgcgattttttaaaaaccatttttaacagtaaaaatttttttcttgctacataaaaatgtacaagaaaaactcagacattaccaatgataaattataattttattaatataaatatttttgtgagctcaatttatatgacttagttattataaaagaaataagcaatatgaggtggccattaccatcctgtcccgttttattttgttcatatgctattgataaatcttgatgtatacagaaaagtagtttcaaagaataataatttttaaaaaggacttgtaatttcaagagacttttaaaaaaatctgcaattgctttttaaaggttctaaaacagttgtctatgccttaaagctaaataactacaaagagctcactcttctcacattctgtattataaatatgtaagtcagagaaacaacagacaaaatcataaaaacacatgcatgaacaaatgggccttggtttacatttaattggatcttgcaatacacatgggttatagtagtatttctgtgtgtaattttacatgagtggattgctatcaaaataaaaattgtctacaatctcttttcagtggtaaatttgcacaaatggtaaacatacacatagagatagtgggagaaatttatttcgtggcttgcaagaagacaggttaagttgggacatttaattgtttcattaatgctacattttaaatgcacttgtatgggcatggtattttaatgtattattatgacttttaaatgctcaatgttacagatggaatattagagcaagtactaacttatatcttctttgtgtgtgctttggaggcatcaggaaataaagcagcccttttcccttttcccagaagctgtgcttctgcagattagatctctctgtaacacacacacacccatgcacgcatgagcgcacacacacgcgcacacacacgagcacacgcacgcgcaggcacacacatgcacacacacgcacacgcacacacacgtgcacacatacacccaatatagcctttagggttaaaaggaggaaaagagaatttgcctggataactcttacccaggtattttctggggagatctagaataatctaagggggtaagctggactagccaatgggaaatcaaaacgaagatactggagagatgttcccagaaaaggagcattcctaatgggcttggccctagtcacatgcaattccccagatgtggttggtgtggccaaggttccagcatttgtcagctgctttcttgccacttcttgtgctgtgaggagtatcccctccccaatgccagaggcagtcgtcctctaacccccttcagagtaaagggccagcaattggcagtcacaggaaaagtagtgagacaggaaggtgcggagcatgaagtcccaccataccggcctccagtgtctggcacagaatatgacgaggaacctccgtgaattggaatcttccacatcttgatatatgggagtttctgctagatataatttgacttaaaaaagaaagaaatatgaccttcttcacctaaatattgtagaagaggtaatgattgcaacctggatgttttacattctgagatgctattaaaccaatattcatcacaaatgtattgataattttttagaagaacagaagagatcccatcatattaaatgaagtgtatcaattataagatgcatgctaactccagaaaaagcaaagcatgaaaaaaatctgtcttagaatggaaaaatacagtagttaaactatttttaactggaatttaaatgcaacattttaggatatgaagctgtcaactcattttgaaaactgctggctcagatgacctcagcgataggaaacctctaaaagatcatgaatctaatcaggtaattttctgtgcctttgcctgagagtctagctgaaagtggtgcagtttttacagaagaggaataacgtgtcccgaactgggaacccttcaccggccaccactccaggcggcgcttcactgtggagttttggtcgccagagggctccaggggactgctggggaaggccaggacatggaagagggcctagagccagggttacccgggagggggtggacccattttgccaagcacctgaggaccataccgtacaggatcctctcaaaaccacccgcacactaggtgggaataaaggataagagaaattaatgtgtgcttagcatgtgagagctgacattcagagtcagcctgagcaaagagattcatacggaaggacgaagcgcatgttgtgagacaaagaacacccaattataagatagaaaaccttggttctgggaaattcctgaacctgtttgcccatccatgaaagagtaagagtgatactaccttctccaccttattcttgtaacagaactgcccgtttctttcgtgcccacagctaagtgtttaataggaacaatgtgacaaatataaggtcattgctcttacacaaaaggttcaagaaaactgagaaagatctaaaaattcccaaaggaatgatttttcaaagtacaacatcttaatttacatagagagaaataatacattttgtctcaaataaagatttggccacatcctaagtatagcattgaagagcagttaagctatttcttcaaagaaaatatatcaaaattaaacctgtactttttgagtgtgaattctaacacacaaacctggtgcaatatatttaaaacaaagcagagattaattaattaattaatgattccccatcaccattttcagaaaacccagtaacttagtgccttaagatgttcaaatcatcccaaaaacttgagttactaaatattttcaaaaccctttctcaagctttgctattctagctttagttggaagaagaagcttccaagttaaagatggtagacgaaatactgacccagttgtgtcctttccctcctgagaaaccatggtggctatccacgatggagagagagcagcggagacaaaaagtgatttgatggcctcgcatccgtgagaaggagcatcatctgtggaccttcctgggggtgaggggcagagaagtgaggcaggcatcagaaaacaggagggtcgattaaaatctgtacattgacagtcaaccctcattatcctccctcaccgatgccagcaccccacccctcgggtaaccagtgagtagaacaccaacaaccaacaagcaagcagctgccttccagagaggagaggagaaggttttctccagaggaaggaaaccatccagaccaaaggcatcacttactaacatgcggaaaccccatcgactccccgaagcaaaacctctagacgagcctttcactaatgataacacactcattctccttcacgtgttactattaaatgtgaacagtgaagaatcaccacctagacgagcctttcactaatgataacacactcattctccttcatgtgttactattaaatgtgaacagtgaagaatcaccacctagacgagcctttcactaatgataacacagactcattctccttcttcacgtgtcactattaaatgtgaacagtgaagaatcaccatctagacgagcctttcactaatgataacacagactcattctccttcttcacgtgtcactattaaatgtgaacagtgaagaatcaccatctagacgagcctttcactaatgataacacagactcattctccttcatgtgttactattaaatgtgaacagtgaagaatcaccacctagacgagcctttcactaatgataacacagactcattctccttcatgtgttactattaaatgtgaacaatgaagaatcaccatctagacaagcctttcactaatgataacacagactcattctccttcttcacgtgtcactattaaatgtgaacagtgaagaatcaccatctagacgagcctttcactaatgataacacagactcattctccttcttcacgtgtcactattaaatgtgaacaatgaagaatcaccagacattgaagggaaacccatctcaatgggaaaaaagaccaaggtaaaccagcaggcggaatgattgttgagaacctaacatcatagcaaaataagaaataagagttttatattatcattcacttagtggcactgtctgaggtttcactatacaaatatattgctttgatatgtgtgtgtatatatacatacatatatatatatatatatatatatatatttttttttttttctgagtctcgctttgttgcccagactggagtacagtggtgtaatcttggttcactgcaaccaaggtctcccgggttcaagcgattctcctgccaattttcatcttttaagtggagacagggttttgccatgttggccaggctggtctcaaacttctgacctcaggtgatctgcccgccttgacctcccaaagtgctgggattataggcatgatagagttttaactattagaagaaaccagaggaagctaccattggaatagatgaaacatcagcaatacattaaaatatcagcaatttcacatgttcgagattacttttaaaaaataaaaagagaacagaattgatttagtttctaggccagcaaccaaggaaaaagcaaggaatggaagattttataatcgcataacaatagcaagatcttacatttctattgagctttaaagattacaggccaggcacggtggctcacgcctgtaatcccagcactttgggaggctgaggtgggcggatcacaaggtcaggagttcaagaccagcgaccagcctggtcaatatggtgaaaccctgtctctactaaaaatacaaaaattagctgggcgtggtggcgggtgcctgtagtcccagctagtcggggggctgaggtgggagaatcgcttgaacccaggaggcagaggttgcagtgagctgagattgtgccattgcactccagcctgggtgacagagcaagactctgtctcctaaataaatacataaataaaaatacaaaaattagcagggcggggtggcacacgcctctaatcccagctactcgggaggccgagacatgagaatctcttgaacctaggaggcagaggttgcagtgagccaagattgtaccactgcactccatcctgggcaacagattgagacgctgtctcaaaaaaaaaaaaaagaaagaaagaaagtagaaaaacttcaaataaaccacctaacaatgcatcttaaagaactagaagagcgagccaggcgcggtggctcatgcctgtaatcccagcactttgggaggctgagacgggtggattgcttgaggtcaggagttcaagaccagcctggccaacatattgaaaccctgtctctaccaaaaatacaaaaaattagctgggtgtggtgccaggcacctgtaatcccagctactcaggaggctgaggcaggagaattgctcgaacccaggaggcagaggttgcagtgagcggagatggcaccactgcactccagcctgggtgacagagtgagaatcagtctcaaaaaaaaaaaaaaaagaaaagaaaagaaagaacgagaaaagcaagagcaagtcaaacccaaaatcagaagaaaacaaataataaagatcagagcagaaataaatgaaattgaaataaaaaaaaatcaaaaaaacaaaaaagtttgttttttgaaaagataaacaaaattgacaaacctttagccagactaagaaaaaaagaaaaaagactcaaatagataaaatcagaaatgtaaaaggaggcattacaacggatactgcagagattcaaaggctcactagagacttctatgaaaactatatgttgctaataaattggaaaacctagaagtggataaattcctagacatattcaacctactgtgattgaaccacgaagaaatccaaaacctgaacagaccaataactaataatgaaatcaaagccataatcaaaagtctcccagtaaagaaaagcccaggacctgaaggcttcactgctgaattttaccaaatatttaaataactaataccaatcctgttcaaactattccaaaaaatagaggaggaggggatacttccaaactcatcctacaaggttaatattaccttgataccaaaccagacaaaggcacattttaaaaaagaacaaaagaaaaaaaacttcaggccaatatctttgatgaacatttatgcaaaaatccacaacaaaatactagcaaacctaattcagcaacatattaataatatcattcatcacgaccaagtgggattgataccagggatgcaaggtaggttccacatatgcaaatcaatcaatgtgatacatcatatcaacagaatgaaggacagaaatcatatgatgattttaattgatgccgaaaaagtatttgataaagttcaacatcccttcatgataaaaaccctcaaaaaactgtgtataggaggaacataccacaacacaataaaagccatacacaacagacccacagctagtctcatactgaagaggaaaaactgaaagtctttcctctaagctctggaacaccacaaggatgcccactttgaccactgctattcaacatagtgctggaagtcctagccagagcaatcaaacaagacaaagaaataaagacatgcaaattggaaagaaggaagtcaaactatcttatttccagattatatgatcttttattcgtaaaaacctaaagattccaccaaaaaactgttagaactgataaacaaattcagtaaagttgcaggatcaacaactgcaactttgttgatcaatgccaatcaacaaaatcaacatacaaaaatcagtagcatttctatatgccaacagagcaagctgaaaaagaaataaagaaattaatcccacttaacaataactacaaataaaataaaatacctagaaataaacttaaccaaagatgtgaaagatttctgcaatgaaaactgtaaaacattgatacaagaaatcaaagaggacacacacaaaatggaaagatattccatattcatggattggaagaatcaatattgttaaaatttccatattacccaaagcaatctacagattcactatcaaaataacaatgacatccttcacagaaatagaaaaaataatcctaaaattcatatggaaccacaaatgacacagaataaccaaactcatcctgagcaaaaagaacaaaactaaaggaatcacattacctgactttaaattatattacaaagctatagtaaagaaaacatcatggtacccacataaaacagatacatagattaatggaacagaatagagaacccaaaaataaagccatacatctacagtgaactcatttttaacaaaggtgccaagaacatacattggggaaacggcaagtcttaataactggtgctgggaaaactggatatccatgtaaagaagaatgaaactagacccctgtctcttgccatatatgaaaatcaaatcaaaatgtattaagttaaatctaagacctgaaactggaagactactaaaaaacaaaacaaaacaaaacaaaaacactggggaagttctccaggacgttggtctgggcacagatttctgtattattattattattactgagacagagtcttgctctctcacccaggctgaagtgcagtggtgtgatctcagctaactgcaacctccacctcccaagttaaagtgattctcctgcctcagcctcctgagtagttgggattacaggcacccgccaccacacctggctaatttttgtatttttagtagagatggggtttcaccatgttggccaggctggtctcagtctactggcctcaagtgatctgcccaccttggcctcccaaagtgctggggttacagatagggcacagatttattgagtaataccccacaaacacaggcaaacaaagcaaaaatgaccaaatggactcacattaagttaaaaagtttctgtacagcagaaaacaatcaacaaaatgcacataaaacccacagaatgggagaaaatatttgcaaacgatccatctatcaagggattaatagtcagaatacacaaggagcttaaacaactcaacatgaaaaatctaattatctgatattaatatgggcaaaagatctgaatagacttttctcagaagaagaccttcagatggcaaacaggttatgtaaaggtgctcaacatcattgatcatcagaggaattaaaattaaaactacagtgagagattatctcgccccagttaaaatgtcttttgtgcaaaagacaagcaataacaaatgctggcaaagacatagagaaaggggaaccctcatacactgttggtgggaatgtaagttagtacaacctctatggagaagagtattgagttgcctcaaaaaactaaaaatagaactaccatatgattcagtagtcatctgcatatacccaaaagaaaggaaataccaaaaagaaaagaaatcagtatatcgaagagatatcactatgcccatgtttattgtagcactattcacaatagctgagatttagaatcaatctaagtgtccctcaacaaatgaataacgaaaatgtggtgcatatacacaatggagcactattagggcataaaaaagtggccaggcacagtggctcatgcctgtaatcccagcactagggaggctgaggcaggtggatcacctgaggtcaggagttcaagaccagcctggccaacatggtgaaaccccgtctctactaaaaatacaaaaattagccgggcatggtggtgtgctcctgtaatcccaagctattcaggaggctgaggtaggagaattgcttgaacccggaaggcagaggttgcagtgagccgggatcatgccactgcactccagcctgggcaacaagagtgagactccatctcaaaaataaataaataaataaataaaataaaatgagatccagtcatttgcaacaatatggatgaaactgaaggacattatattgagtgaaataagtgagacacaagaagacaaacttcacatatgctgtcacttatctgtgggagctaaaaattaaaacaattgaacccatggagatagagagcagaatcacagttaccaaaggctgggaagaacagtgggggaagcggggaagagaatgggtaaaaaatataattagatgaataagatctagtatttgatagcacagtagggtgactatagtcaacaataatttattatacattaaaaaaactaaaagattataactggaatggttataacacaaagaaatgaaaaattattgaggtgataaattttttaaaaagtggtggggctggagccgtggctcatgcttgtagtccctgcactttgggaggctgaggcaggaggatcgcttgagttcaagagctggagaccagcctgggcaacatggcgagacctcgtctctctccacaaaaaaattaaaaaattagccaggcatgatggcacgtgcctgtagttccaactactcagaaggctgaggtgggaggactgcttgagcccaggaggttgaagttacagtgattgtgccactgcactccagcctgggggacagagggagacaccagtctcaaacaaaacaaaacaaacaaacaaacaaaaaatgtagtaaaaatggccattgtttccttgttcttgattttatagatgaacaattcagttttttatcataaattttggatgctagctgtaagttttattaggtgccattttattagtttgagaaagcttcctattatccctagttttataatgaaacggtgtaaatctgcacaagatgctatttctgcatctatggcatgatcatgcattttctcctttattctgtcaatatggtgaattaccctgattgatttttcatgactttattgatatataatttacatacaataaaaatcatcctttaaggcggggcacggtgcctcatgcctgtaatttcagcactttggaaggccaagatgggcggatcgcttgagcccaggaattggagaccagcctggcaacatggcgaaaccctgtctctacaaaaaaatacaaaaattagccagacacggtggcatgcacctctaatcccagctacttgggatgctgaggcaggaggatcgcttcagcctgggtgatgaaggctgccgtgaatggtgattgcactactgcactccagcctgggcaacagagtgagatcttgtctcgaaaaaaaattgttaaagacattaaattaaaaatatttaaacaaaggctgggtgcagtggctcacgcctgtaatcccagcactttgggaggccaaggcgggcagatcacaaggtcaggagttcaagaccagcctggccaacatagtgaaaacccgtctctactaaaaatacaaaaattagccgggcgtggtggcacgtgcctgtagtcccagctactcgggaggctgaggcaggagaatcgcttgaacctggaggcggagcttgcagtgagccgagatcgtgccactgcacaccagcctgggagacagagcgagacttcttctcaaaaaaaataaataaataaaaaattaaacaaagtaatggttggttggatgcagaaaatagtttaaaacattttttaaattaaaaaaatcactcttaaaaagtgaattcactctttaaaagtgtacaattcggtggtttttaagacatgcacagagctgtataaccagcacccctacctaattttagaacattctgtcactgcaaaaagaaaccccatacccattagctgtcactccccgcttcctcctcatccagcccatggcaatcattcatctactttctgtctgcgtagatgtgcctgttccgggcatttcacagaaatcaaatcatacctatgtggtctttggtgaagggcctctttcactcagcatagtgggttcaaagtacacccgtgttgtagtactttattcctattttttagaatgttttattgtggtaaaacacacataacataaaatacactattttagccacttttaagtatacaactcagtggcactaagtacattcacaatgttgtgtaactcaccactatttccagagctttctcttcatcctaaacagaaactctgtgcccatcaagcagtaacttcccgtttcctctgtaccccagcccctggcaacctctattttactttccatccctgtgaatctgcctaatctgggtacctcatataactggaatcatacagtatttgtccttttatgtctgacttatttcacttaacataacgttttcaaggttctaaaatacaaaaggttccaaaaatacaaaaattagccgggcgtggtggcgggcgcctgtagtcccagctacttgggaggctgaggcaggagaacggcgtgaacccgggaggcggagcttgcagtgagccgagatggcaccactgcactgcagtctgggcgacagagcgagacgccgtctcaaggaaaaaaaaaaaaaggaagggcaaaaaccgccattacttttccgccaacccaaatcgttgggtgactcagcgcatgcgcattcctctgcggggccacatctcaagccacaggcttcccagagcctataggagagatcccacattaatttaatttaattatttatttatttacttacttttttaaaaaaatttatttgagacagagtctctttctgtcgcccaggctggagtgcattggctcaatcaaggctcactgcagcctcgacttccgcggacttaggtgattttcccacctcagtctcccgagtagctgggactacaggcgcacgtaacccccaacccggataatttttgtattttttggtacagacggggtttcgctatgttagccaggctgttctcgaactcctggcctcaggtgatccgcctgcttcagccttccaaagtgctgggattacaggcctgagccaccatgcggggcctgaatttcaaattaggtttttctatttctgcaaaaaacacccctgggattttgaaagggattttgcattaactctgtagataggctgggcagtattgtcatcttaacaactacgcctcccaatccccaacatggaatatccttccatttatttatgtcttctttaattcttttggcaatgttttatagttttcaatacataagtttaagtcttgtgcctccttcgttaaatttattcctgtgtatttttaattctttttgatgctttttttttttttttttttttgagacagaatctcactctgtcacccagcctggagtgcagtgcagtgcagtggcacaatctcactgcaacctccgcctcccaggttcaaaagattctcctgcctcagcctcccaagtagctgggattacagctgcgtgccaccacacccgactgatttttgtatttttagtagagacggggtttcaccatgttggccaggctggtctcgaactcttgacctcaggtgatccacccaccttggcctcccaaagtgctgggattacaggcgttgagccactgcacccagccagaattgttttcttaatatcctctcggaatgttcattgctagtggataacaatgcagctgattttcgtgtgttgattttgtatcttgccatgtctctgaattctggagtgagatgtaaccattttattgtggattctttagaatttgctacatgtaagagcgtgtcttctgtgaacagaggtgattttacttcttcctttccagttcagatgcgatttatttttggccgagttgctgtgactacaacggctactactgtgttgaatagaagtccttatcttctttctgatgtttggggtaaagttttaagaaattcaccattgtatatgatattagctgtgggtttttcagatataacctttattattttgaaggaattcccttccattcctagtttattgactgctttatcatgaaagtgtgttggactttgtcaaatactttttctgtatcaattgagatgatcatttggggttttccccttcattctattaatgtggtgcatcaccttggttgattttcctatgttgaaccatccttgcatttacagactaaacctcacttagtcatggtatataattattttgataagctgctaaatttggtttgctagtattaaacattttgcatcaatattcataatggcggacgggcacagtggctcacgcctgtaatcccagcactttgggattccgaggtgggtgggtcacgaggtcaggagttcgagaccagcctggctaacacggtgaaaccccatctctactaaaaatacaaaaattagctgggtatggtggtgcgcgcctgtaatcccagctactggggagggtgaggcaggagaatcgcttgaacccggcagagggaggttgcagtgagccgagatcgtgccactgcactccagcctgggcgacagagcgagactgtctcaaaaaaaaaaaaaaaaaaaaaagaagaagaattcaccagtgaaaccatctggtgaagaaaaggccaggtcttactgattcaaccttagtagttcagagtctattcagatgttctactgctttatgagtcatttctggtatatcgtgtatttctaggaatatgtgcatctaatctaggttatccaatttgttgtatacaactgtttatgctattcttttataaaccttttactttctgttaaattggtaataatgtctccaatttcatttctgattgtagtaaactgaatcttctctctttttttctgaatccacctggttaaaagtttgtcaattttgttgatgttttcaaagaaaaactttggtttcattgattttctctgtttttctattctctacttcatttatctcagctctggttctttatgatttcctttcttctagctttcagtttaatttgctcttctctttctagttctttgaggtgtacagttaggttgtcaatttcagatctttcttctctttttaatataattattatttgtcaattatgcctcataagaagaaaagaattctgagtaaaaaataaaataatacagaatttgtcagctacataaaaaataaaacacagccatattttatttacaaaagaaacattttaagtatgtagacatacatagtctaaaactgaaaggatgaaaatagatcatgcaaatattaaccaagggaaaaattatatggctatattaatattggacaaagtagatctaaagtagaattacaagatataaagatacgcatttcaaagtaataaaaagatcaattccataggcagctcataaatttgtaaatatctaaaagcatgaatttcagttatgtaaagcttacagaactataaactgtggtttatagcttataactatagaagtaatatacaagtccggtggggcacagtggctcacgcctgaaatcccagcactttgggaggccgagatgggtggatcacgaggtcaacagatcaagaccatcctggccaacatggtgaaaccccgtgtctactaaaaaatacaaaaattagctgggtgtggtgatgtgtgtctgtggtcccagatactcgggaagttgagacaggagaatcacttgaacccaggaggcagaggttgcagtgagctgagatcacgccactgcactccagcctggtgacagagtgagactccatctcaaaaaaaaaaaaaaaaaattagtagaagaagaagtaataatacaagtctgcaatcgtaggggacactaatccactgtttgcagtatttttctttcatgtatagatttacaactataaatttccctcttaatgctgtttttgttgcatctcataagttttggtaggtatattttcttcttcatttatttatcttaaggtattatctaatttctcttgtgattctttgttagctcatttgtatttaagagtgttaatttccggccgggtgcagtagttcatgcctgtaatcccaacgctttgggcggtcgaggtgggcagatcacaaggtcaggagttcaagatcagcctggccaacatggtgaaaccgtctctactaaaaatacaaaaattagctgggcatggtggcacacgtctgtaatcccagctactcaggaggctgaggcaggagaatcgcttgaacctgggaggcagaggttgcagtcagccgagatcgtgccattgcactccagcctgggcaacagagcaagactccatctcaaaaaaaaaaaaaaaagtgttaatttccatatatgtgtgaattttcaagttttcattgttattcatttctagtttcattccattgtgattggaaaaaatgctttgtctgatttcagtctgttgaaatgtattaaaacttgtttttggccaggtgccaaaacaagtttgtgtcaaatcttttatcactatataatgcccttttttgtattttgtaatcattttaaagtctattttattgataataatacaaccactcagctctcttttaattactatttggtaaaataccttttttcatcattttacttccaacattatgtccttacatctagagtgaatctcttgttgacaacgtatagatggatcttgttttttttttttaaatccaatctgccaatcccagccttttcataggagagtttaattcagttacatttaatattagtgataaaactatattttcttttgccatttatgcatttgtttttgtatgtcttacattttaaaaattcctcaataccttcattactgcctttttgtatttttttaagtgtactttttaaactcctgtcatcattccatttctgtacatttttaaattattaacggttaacatgggggctacaattcacatcttaaatgtataacaacctagttttgttttgttttgttttgttttgttttgttttgttttgttttgagacagggtctcactctgtcgcccaggctggagtgcagtagagcaatctcggctcaccgcagcctccacctcctgggttcaagtgattctcctgcctcagcctcccaagtagctgggattacaggcatccaccaccacacccagctaatttttgtatttttagtaaagacagcgtttcaccgtgttgggcaggctggcctctaatactggcctcaagtgatccacctgcctcggccacccaaagtgctgggattacaggcatgagccaccacgcccagccttaaatttgtaacaacctagtttgaataataccagcttagatccaatagtatatactatgctcctataaatctgtctttccctctttatatgttattgtcacagattacttctttatacattgtgtactgattaacatagatttgtaattattgttttgtgcatttgcctattatataagaaaaagagaaaagccacaaggaatgccgaaagtacaataatactggcttttatatttatccacatagttccctttaccactgctctgtcttttggtctcatggcttgagtcgctgtccagtgtcctttcatttcagccttataccacttagcgtttcttgcagatcggttatactggtaatgagctccctgagctgttgttcatctggaaatgtctttattttctccttcattgttgaagaacagctttggcagatatagaattcttggttgccagtttttttctttcagaacttcatgtcatccccattgcctctggcctccatggtttccgaagagaagcagctggtaatcttacccaggccctcttgaatgcggctggtaatcatcttaccaaggctcctcttctatgtgatgtgatgtgtcagttctcttttgctgctttcaaaattctcctattcttcctttgggttttgataacttgattatatgtctcagtgtgcatttatttgagtatatcctacctgaagttcactgagcttcttagatgtgtgtattcatggttttcctcagatttggaaagttttaaccatcatttcttcaaatgttttttcttcccgtttatctctgccttcttctgggacttttataatttacatgttggcatgtttaatggtatcccacagggacctcaggctctgttgtttatttttcttcattctttttccactctgctcttcagattggatagttcgttgttttagagacagagtctcaccctgttgcccaggctagaggacagtggtgtgatcatagctcactctaatccccaactcctggctcaagcaatcctcccacctccacattccaagtagctgggactatagtacctgccaccacacctggctaatttaaaagaagaatttttttttttttttttacagatgggatcttgccatcttgcccaggtctcaattgatcctcctgccccaacctcccaaagaacagagattacaggtgtaaaccactgcacctgccagactggggagttctaattttcttatattacagtttactgatcctttcttctgcctgctcaaatgtgaacccctagattgattttcttttctttttttttttttttgagacagagtctcattcgtcactcaggctggagtgcagtggcacaaacatggctcactgtagccttgacttgacaggctcaagcgattctcccacctcctcagccccctgagtagctgagactataagtacgtgccaccacacccagctaatttttgtgttttttgtagagctggggtattgccgtgttgcccaggctggtctcaaattcctgagctgaagtgatccacatgcctcagcctcccaaagtgctgagattataggcatgagccaccatgccccactctatagcaacttttttatttcagttattttatttttcagctccagattttctatttggttgcttgtaataatttctatctctttattgatattctcattggttcatgtatagttttcttgatttcctttattttttttccatagtttcctttagctcattgacatatttaacacagttgatttaacatcttggacgaataattccagtgtctgggcttcctcaggggctaatttctgtcaaattggtttctccccctctccgtgtgtaggctacacattcttgtttctctgttttgtaatttcctcattgagaactggaaatatttgaacactgtgttgcagtaactctggagatctaattctctcagtcctcaggggttgcagaaccttgtttattgagtgttggagccatccattgtgacttttccgaactattttttgcgaagcatgccttgttatgtgtggtcactaaggtttttgttctattacctcagcagtcaccttccccagtcaaaagcagcaatcagccatcaaaatacagaatcctgaggtttggaagacaaggttcttattgcccaccccggcttccggaagccaccccaggaatagagaccacccttctctcagctgcctgctgtggggctgggaagtggggatttgaggcactaccgacaaagccaaaaattgggttctctcctggatgttgcacatgttcaactagaccccagttccacaataatgactcggaacagttcctgacaacgcaatggtcgttaagtggaaagatggcttcctggcacttcctaatataccaccacctatgacatcactccatttcttttcattgccaaagcatattcccttgtgtgcttacatcatattcccttgtgtgcttacatcatattcccttgtgtgcttacgtcgtattcccatgtgtgcttatatcgtattcccttgtgtgcttacatcatattttgtttatttgttcatctggtgatagacttttgggctgtttccaatttgaggctattataaataatgctgctatgaacattcccatatacatttttatgtggacatgttttcatttatcttggatatatacatacgcatggaattgccagatatactgattttttaatgttaaactacacttgcactcctgtaataaactctacttggtcatgatatattggattcaatttgcttgtattttgtgaaggatttttgcacatatattcatgaaaatattggtctgtaatttttgtttttatactatctttgttagttttgggcatgttatgttggcttcataacaagttggacaattgttcctcctctatgttctaaaaaagtttgtgtaattgagttgtgaggtggggtttcgctcttgttgcccaggctggagtgcagtggcgcagtctcagctcaccataacctctgcctcccaggttcaagcaattctcctgcctcagcctctcaagtagctgggataacaggcacgcaccaccaacgcccaggtaatttttgtatttttagtagacgtgcggcttcaccatgttggccaggctggtctcgaactcctgacctcaagtgatccacccatcttggcctcccaaagtgttaggattaccggtgtgagctgctgcgcccggcgtcgttacggttttgaattacacctatgtacacctgtcttactgaacacaggaaagagatattcgtcacagatctatgatggtcattacatttatttcctcaatcaataaaagagaaataacacgtaggaaagatgagttactattcccgagaaacaaccaatcaagaacatatcgaatccaaactaatgatgtgaaatattagttcttatgtcaggaatgtgatcctgcttttacttgagtgaaattaaagtgtggaaattggccgggtgtggtggctcacacctgtaataccagcactttgggagggtgaggcaggcggatcacctgaggctgggagctcgagaccagcctggccaatatggtgaaaccccgtctttactaaaaatacaaaaattagccaggaatggtggcggatgcccgtaatcccagctactcaggaggctgaggcaggagaatcgcttgagcccaggaggtggaggttgcagtgagccacctctgtactccagcctgggtgagggagtgagatgctctctccaaaaaaaaaaaaaaaaaaaaaggaacaaaaagtgttaaatttgaggtcaaggagaagaaagtggaccacaattttatataggtaatatttttgtgatggaagtaaaatagacatgcagatttaaaaataataattgtatatatgggtctactcagatgtcctgattttacgttaattttggtaatttgaatatatcaataaattcgtctacttatatttaagttgtcaaatttggggacataaagttgttcagagagccagacgcagtgactcacacctagaatcccagcaactcgaggctgaggtgggaggatcacttgaggccaggagttcaagaccagcttgggcaacatagcaagagcttgtctttaaaaaaaaaaaaaaaaattaaggccgctaccgccggcctgtgcccgcctgtgtggcgcgggcctggaggagccgtcgtgggctcgggtggaggctgctcctgtggagggtcgtcctggctcacagccgccatcatgctagcgctcatctgccgcctgccggacggtccccttcgctcgtctggaaggaggagatggagccgatgctcgtgggctgcagtactcgggcaaggccaccttcgtcactgccatcacgtcaggtgaattcagcggagatatgacggccacagtgggtttcaacacgaggaaagtaactaaaggtcatgtcacaataaagatccaggaccggccgggcggtggctcacgcttgtaatcccagcactttgggaggccgaggcgggtggatcgcctgaggtcaggagttcgagaccagcctgggcaacacggtgaaagccccatctctactaaaaatacaaaaaattagccgggcgtggtagcgggtgcctgtaatcccagctactcggaggctgagggagaagaatcgcttgaacccgggaggcggagcctgcagtgagccgagatcgcgccacgtcactccagcccgtgtgacagcgacgagtcaaggctattgtttacaggatagatgctgcagatcgtaagaagatagaagcttcccgaaacgagctacataatcttcaacaagagcaaaactccaagtcaaaaacaaaacaaaaaaaaattgagacttgttttaccacccaatgtattagtccattctcacattgctttaaagaactacctgagactgggtaattcataaagaaaagaggtttaattggctcatggttccgccggctacacgggaagcatgactggggaggcctcagggactgcgccatcatggcagaaggcagaggggaagcaggcgcatcccacacggctggagaaggaggaagacagcaaaggcgctgcgcactctcaaactacccgatctcgtgggatctaccatgacagcagcaagggggcattccgcccccgtgatccaaccacctcccaccaggccccctcctccaacactggggattacgatttgacctaagatttgggcagggacacaaatccaaaccgtatcacccagtatatggtctatcttgctgaatataccacatatacctaaaaaaagtatattttgcagttgttgaatgtggtgttctacaaatgtcaagtagattgaggtggctgatacagtggttcaaataatttgtcctgatttttttggtctagcttctctatttactgctaagaaatgggtgttaaaatctattttaatggcagaattttcatttctttttcatgtattttaaggtgcatacgtatttataagtctgctatcttcctgaatggctctctttacaattataaaatattcctatctttacggtactatctgttcaaagtctatttaatcttatatttatataaccattccagtcatagtatgctagtgtacatattgtattttttcccctttcaattcatctgtctttaaagtttcttataggcagcatataaatgggccttgattgttttttaatcatcagtcttgattagaatgttaacatgtcaataatgtaattattgatatggctggactcagcatgccacttcaccagtttttttgtttgttcctcttttggttcctgccaattctttcccttttgaggtcacttctccaagttttactcccctccactgtttgcctacctttgtttacatctcaggtttgggagagttttccccccgtcttactgagcttctggctgtaagcagcaggagggataggttgtaggaggcttatgtggtgactgtggaaccagagcccccatatatgcttttaggaagatctggtatagaattctcatttatgcacagacaactttgaaaatgtacataagaaatcggtaaatgaccaggcccagtggctcacacctgtaatcccagcactttgggaggctgaggcaggtgtattacttcagtccaggagtttgagaccagcctgggtaataaggcaaaaccccatctctcaaaaaatacaaaaattagcttagctgggcatggtgttgcctgtctgtagtcccagctactctcaggaggcttaggtaggatagctggaatccaggaggcggaggttgcagcaagctgaaatcatgccactgcaatccagcctgggtgacaagagcgagaccatctcaaaataaaaaaagaaaaattggtaattgtggagatttagagggatgacaactctggagactaagaggaaaatactttttaatacagacttttctgcactttgaccgtatgtgaatattttcaaaaaaggcattaaaaattatacaaagctggccaggtgcggtggctcacgcctttaatcccagcactttgggaagccaaggcgggcggatcacctgaggtcaggagttcgagaccagcctggccaacatggcgaaaccccatctctactaaaaatacaaaaattagccgagcatggtggcatgcacctgtaatctcagctactggggaggctgaggcaggagaatcgcttgaacctggaaggcagaggttgcagttagctgagatcacgccattgcactccagcctgggcaacaagaatgagactccatttcagaaaaaaaaaaaaaagaaaagaaaagaaaattatacaaagctgtccatttggggtggattaagcatgaggcagcttaaagggcaaatgcagcaaactgcaaaggctttatttaactcagcacctaaacctgttgacagccacaaggaagacattggtatctgatattgaattctaggcaaagctgtcttgcagataaccaggtgttttacaaatatttgtttaggacagcttcctaacccatgacctttcacataggcagtttctcccgtagaatacagcagtttaataatcatcttgcttctcaagggtatgaatgtggctaatttggacacgggaaagctggggcataggtgaggcaattaggcttccaattctaggggccacaattttcgtggccatacttaagaatcctggctggcactcatagcaatgagattcaattgtgtgatggattttttggtaaccacacggtagaaggccaaaataagaaaactctcaacaattacgccttttgctatagagctggtgtccactaaccatgtggctactgagcacctgaaatgtggctagccaaaactgagatgtgcattgcttgaggtacaagggagtttgaagacacggtatggagcacacctgtaatcccagcctctcaggaggctgaggcacaagaattgcttgaacttgggaggtggaggttgcagtgagctgcgatggcaccactacactccagcctaggcgatggggcgagactgtctcgggaaaaaaaaaaaaaaggaggcagagcgtggtggtggctcacacctgtaatcacacactttgggaggctgaggtgggcagatcacttgaagtcaggagttcaagatcagcctggccaacatggtgaaaccccatctctactaaaaatacaaaaattagccaggcgtggtggcccacacttgtaatcccagttgctcaggaggctgaggcaggagaatcacttgaacccaggaggtgggggttgcggggagccgagatagcgccactgcgccccagcctggacgacagcaaagattctgtctcaaaaataaataaaattacatatgtggtatatggtgacaatatattgtatatttagaaattgccaatagaggctgggcatggtggctcacgcctgtaatcccaacactttgggaggctgaggcaggcggatcacctgagatcaggagttcaagactagcccggccaacatggtgaaaccccacgtctactagaaatatgaaaattagctaggcgtggtggcagacacctgtaatcccagctactcggaggctgaggtaggagaactgcctgaggcggaggctgcagtgggctgagatcgcccacttagaagacagcagcaatcatgtaccttggtatttacctaaagagctgaagacctatgttcacagaaaagatatacacacaggtgcttatcagtttattcataactgccaaaacttagaagcaagattacttagtaagtaggtgagctagataaactatggtaactgcagacaacagaatattgttctgtgctaaaaagaaatgaggtatcatgtcatgaagacatggaggaaacaaatgctattgcttagtgaaagaggccaatctgaaaaggctatattctgattccaactgtatgacagtctggaaaaggtaaaattatggatatagtaagatctgtggttaccagggccttatagaagagatggatgaatgggcagagcacaagatttacagcaataaaaactattctgtaagctactagaatgatattacatatttgtcaaaaaccgtagaacaaaccctaacgtaaacagtagactaatgatgctgacggtgctaatggtgcacccgtgtaggctgcccattgtaacaaatatgccgctctggcgcaagctgttgaccgtcatggaggatgtgtaagtggcagaaacagtggatgtgtgggaattctgtttaattttgctatgagcctaaaactgctctttttaaaaaatttatctaaagaaatgacaactcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctctgaggggatggcggcccctaaccggcggtttatagcctggccccgcccccggcccccaggggggctgtgcgtcacttcctgaggcacgtacgctcgcgaggtgctctgacagatcgcccggggggcggggatgcgcgcgcagcgggcggggccctatgcggagggcgctgcgggcgaggcgaaggccaagggaaaaggcgccaaggcagcaggtgccccgaggagccgcgcgatgggcgcactggcctctgcctcggcgccttcctccaccctggtagcctggcagcctccgcctgaccttgaccaacctccagtccctgcagtgctaggtccaatctgttggcgttgacgcttaaatgttggatattgcactgcggcagtgccttgaaatgtacgtgcaggatggaatgttaggtaactattaaagccactcttgtgaagatgtattttgcagcctcagaaatacaaaaaggaaaagaaaagcaaaatgcaaatttttattcagaatgtatacaagctgcactttaaccaagactagcggagtgctttgcgtaatgtttaatgcatgagggaataaaagggaaaatagaaacaagtgacttaatagggtgataggattgtagattaactttcgttttcattgccatcgctgttattggattgtgcaatgaataacaaataaataaaattcaattcttgtcactgtttaaactctttccaaacaatcacaccctctccctccctctggtcagtaaccagcaggccagggaggtagtagctacaatgcaagaaagcaacccataccttaaaaagcattgcacataaactgaccttcaggcccgtagggacacagaacagccctttaagaagcaaatccgtttctgggccttgggcttttactcttccctttatttcttctgctctaagatagagaaagtacttgggattctcaccgcctttctctttactcccattctctaaaatctctctccccaaagagaagtgtttaaaagtcatatgagttgccaggcgcggtggctcacgcctgcaatcctaacactttgggaggccgaggtgagcggatcacgaggtctggagttcgagaccagcctgaccaatatggtgaaaccccatctctactaaaaaaatttcaaaaaaaattagccaggcatagtggcacgcgcctgtaatcccagctactcaggaggctgaggcagaagaatcgcttgaacccaagaggcggaggttgcagtgagccaagatcgcgccattgcactccaacctgggcgacagagcaagattccatctcaaaaaaaaaaaaaagtcatatgagcaggagcattgctgcacctttaatgatctaatcaggaaaaggttaaggatgcacatccacagagggcctaccttaacattcagacaccaggcctgctcccctgtggtgttccttctttatttctttaattattaattttatttatttttattatttttacttttaagacagtgtcttgctctgtcaccctggctggagtacagtggcatgatctcgggctcactgcaacctctgcctccggattcaagcgattctcctgcctcagcctcccaagtagctgggactacaggtgtgtgccaccatgccaggctaatttttgtattttgaggagtgacgggattttatcatgttggccaggcttgtctcgaattcctgacctcaggtgatctgcccaccttggcctcctaaaatgttgggataacaggcatgagccaccatgcccagcctatttattttttatttttaatttgacgcagggtttgctatgtagcccagactagtcttgaactcctgggctcaaacaatcctcctgcctccggtctcccaaagtgctgggattataggcatgagctaacatgcctggctttctgcctttccttgactgaagtatcttttaaaaagaaacaaacaatgctggtatttgcaggtgaaaatcttatagcctcatggaggacataggtttaggtggccagatgcgatggctaatccctgtaatcccaacactttgggagactgaggcaggtggatcttctgaggtcaggagttcaagaccagcctggccagcatgataaaaccccatcacaactaaaaatacaaaatttagtctggcgtggtggcgcacacctgtagtcccagctactccagaggctgaggcaggagaatcgtttgaacccgggaggggggtggctgcagtgagctgagatcacaccactgcccttcagcctgggcagcagagcaagactctgtctcaaaaaaaaaaaaaaaaaagaaagaaagaaagaaaagaaaagaaagaaaaatatgtttaggagacatttagaggccaggaccatttggacatgaaaattcaaatctcaaaaatttatattcactaaaataaaaccataaacgtgacactaaagaggctatcaattatatttttatttttatgctgttattagtattaatagacactgcaattaaagtccacttattaacacttttactatttatttatttatttttaaacagtcttactctgtcacccaggctggagtgcagtggcgccatctcggctcaatgcaacctccacctgggttcaagcgattctcctgcctcagcctcccgagtagctgggattacaggcacgtgccaccacgcatggctaattttttgtatttttaatagagacggggtttctccatgttggccaggctggtcgtgaactcctgccctcatgatctgcctgccttggcctcccaaagtgctgggattacaggcgtgagccaccgagcctggccaaattattcgaaattattattggaaattatttaatttccaaccctccacaaactattccatgaggcttacctcatcctggaactaaaactcttgcagttcttctgcatcgtacacagaaatacgagaagtttcataaagggaaggaggttggcaaggaaaaagataccatgagctgtggggaaaagaaaagagcacaaagcctggagggccaagaagctggagttctcaactttcctgagcctgggttgtaccagctctaaaatgggaataaaggctgggcacggtggctcacacgtctaatctcagcactttgggaggctgaggcgggcgtatcatttgaggtcaagagttcgagaccagcctaaccaatgtggtgaaaccccatctctactgaaaatacgaaaattagccgggtgtggtggcaggcacctgtaatcccagctactcagtaggctgaggcaggagaatcgcttgaacccgggaggcagagggtgcagtgagctgagattgtgccactgcactccaggctgagagacacagcaagactccttctcaaaaaataaaatgggaataaaaatacctcattccaaaaatacctcttttagggtctagaagaccctaaaagcaatgactggcacatcatacactgttggtcagcatggttgaatcagagtcctcgtggggcggagtggggtcaggtaggaacgtgacgtggaagatgtctgcagactgggatggatgtgggctcatgaagaggaaggatgaaggcatttcagcagaggagaaccggccacctgaaggctctgtagtgagaaggagcctgtggtgtgtgttaaaattcctaaggagatgtctgacagctaattcaggggaattactgctggaaacaacagtgcaggatgattaacggcaaaattctgcctccctctcttttttcttcaccaagagatgaaagcagaagtcttgctttttggtgagagagaactggcaggaaaagcaaaccagataagccacttacctagtgaaagagccccagctggcagggcatggaggctcacgcctgtaatcccagcactttgggaggcagaggcaggaggatcacttgaggtcaggagttcgagaccagcctggccaacatgacaagacactgtctctactaaaaatacaaaaattagccaggcgtggttttgtgtgcccataatctcagctacttaggaggctgaggcaggagaatcgtttgaacctgggaggcggaggttgcagtaagctgaggctgggccactgcactccagtctgggtgacaaagtgagtccgcctcaaaaataaaataaaaagcccccgcctagaaattagcaacttgtcccagtgggactgtcacccactgtgctgcggaaacatgggcgtcagtcatggctctgtacttcattttccctgtctgccatgtggaaataatatccctttattgccttcattcatttaccagtgaaataaaaagtaagaaaacttattaaactacatgtttatacaaatttaaggtgttactagtgcagagcccagtctaagtgaataaatgtggtggtgacgggtcgaagctttaaaaaaaaaaaaagaaaaggaaaatttttttttctcgctctgtcacccaggctggagtgcaatggcgcagtctcggctcactgcaacctccgcctcccaggttcaagcgattctcctgcctcagcgtcccgagtagctgggattacaggtgcctgccaccacacccagctaatttttgtatttttagtggagatgcggtttcactatgttggccagggtggtctcgatctcctgacctcgtggtctgcctgcctcggcctcccacagtgctgggatttcaggcgtgagccaccgcgcccggcccttcaacggcttttgaatgcacctactccagaaaaagtgacttggtcattgataatagtggatacagaaaggtaatgccatcattatttatcgagtactgttatgtgctggaaaaggacgtgtaaagaggtaagaagcaagtctgtacccctgaaaaggcaaacaatgtagctggggaagcataatgtatatttataagaacttatatttaaaggccaggcctagtgcggtggctcatgcctctaatcccagcactcaagaggccaaggcaggaggatcgattgcttgaggccgggagttcaagaccagcctgtgcaacacagtgagaccccctatctctacaaaaaaaacttaaaaattgccaggtgtggtggtgctgcctgtagtcccagctactctgggggctgaagtgggaggatggctggagcccaggagttcagggttacaatgaactgtgattgcaccactgcacccagcctgggcaacagagcaagaccctgtctcaactaataataataataataataataataataaatatataatgccagtcactgtggctgtagtgagccgagattacatcactgcacccagcctgggcaacagagcaagaccctgtctcaaataataataataataaatatataatgccagtcactgaggctgtagtgagccgagattgcaccactgcactccagcctgggcaacagagcaagaccctgtgtcaaataataagaataataagaataaatatataatgccagtcactgtggctcatgtctgtaatcccagtactttgggaggccgaggcaggtggatggcctgagtgcgggcatttgagaccagcctggacaacatggcaaaaccccatctctaccaaaaatacaaaaaattagctgggcatctggaggctgaggtgagagaacagcttgagcttgggacgctgaggctgtagtgagccaagattgcattgctgcacccagcctgggcaacagagcaagaccctttctcaaataataataataacaataataataataataaatatataatgccagtcaccgtggctcatgtctgtaatccgcagtactttgggaggccgaggcagatggatggcctgagtgcaggagttcgagaccagcctggacaacatggcgaaaccccatctctaccaatagtacaaaaaattagctgggcatctggaggctgaggtgagagaatggcttgagcttgggaggctgaggctgtagtgagctgggattgcattactgcacccagcgtgggcaacagagtgagactgtctcaaaaaaaaaaatcccacaaaaataccattaatttgccaactttgtaatagagttacaaagttgccacttgctctttctggggtcctacctgtggcccaaacagcagatgaagtctcttagttcagcatttctcaaacgttttttactgcatttcatggacaaatgtccatcttacttcacaactcagtacacccatgtgtatgcgtgtgtgtatgcgtgtgtatacacgtgtatatttccttcagtatacccacgtggatgtgtgtgtatatatgtgtatatttccttgaaacccaaagtaaaagtttcatgaaataatacccttgaggtgtggaaagccctccagaattttctattctatttaatagtaaaaatgctaatttttaacccattcaattgatttcccaatgggccgtaacctatttttgaaaagcatagtcctaggccatttcctctctcagagcacaagactttttagtgaacaggataaatgactttttagtgaacaggataaatgatgctcaaagttaaatttcaattcccaaggtttctccctgttctttctgcttgtcgctgtttcaactttctaccgccctacatttcagcaaatattggttacggtttttttgtttgtttgcttgtttgtttgtttttaatgagttgggaggctgagttagaaggcagagagaaagtcttttcaatcttttttttttttttgagatggagtctcactctgtcacccaggctggagtgcagtgatgcaatctcggctcaccacaacctctgccacctgggttcaagtgattctcctgcctcagcctcctgagtagctgggactacaggcgcaccaccacgcctggataatttttgtatttttattagagatggggtttcaccatgttggccgggctggtctcgaactcctgaccccattgatccacccgcctcagcctcccaaagtgctgggattacaggcgtgagacaccacacccagtgttttcactatttttacttttttaaatttcttaaaataaaatatgtagaacgagggtctccctatgttgcccaggctggtctcaaactcctgggctcaagggatccttctgcctcggcctcccaaggtgctaggattacaggcttgagccaccatgcccggcctgaagtcttttcaaatgctgtcaaatagctgcacacactccggtcagtgagggcagcaccctgcctgtcacacggctggtcttcacagcagcttctacagaaatcactctaacctacctttagctctgaccctagctcctatttaacatgccggatccattttattttccttggaatcctaagcctcgggcaatcactttaggaccagagtcataaaataaaaatgtggagctctgccactttggaagaggatgcaacctagaaaaaaggcaggtggactgtcaactcatagatttgaggttgatactattttccattttattttgcatttctttttctccaccctcagtttcctgtccttatcctgctgactcaattattttttctttctccattgccaaacggaaggtcacccacgagaacatggaataggggcaagattcagattaatatggaggagtttgctcccattttatagcaaatggaaaggttacttaggacagtgaaagataactaattttgttttttttttgtttgtttgtttgttttcttttgagatggggttgtgctctgtcacccaggctggagtgcagtggcacgatctcagctcactgcaatctccaccttccgggttcaagtgattttcctgcctcagcttcctgagtagctgagattacaggtgcccaccaccatacccagctaatttttgtatttttagtagagatggggtttcaccatgttggccaggctggactcgaactcctgacctcaagtgatgcacccaccttggccttccaaagtgttgggattacaggcgtgagccaccatgcctagccaaagacaatttttaaattgattacaaggacatttatgccaaccagtacagtggtctaagttgaagttttgagtaggatatgaagttctatttagtcccattcggaggcaaaatagaactcactgcataatagagtttcaagttcagaaggaactatataactaatgtactgtctctgacctatagtaggtgctcaaaaaatgtatgttgaattaattcaacaaaattcctctacttcacctcatcaggtggttatctagtgtctcctttacctctccaatgggagcaaatctataatttcccaaagcagaaagacctgggcagtttgaactgtcagaaagtttttatctgggccaggtgcggtggctcacgtctataatatcagcactgtgggaggccaaggtgggcagataacctgaggtcattcaagaccaacctggccaacagggtgaaaccccatctttactaaaactacaaacattagccaggcatggtggcgcacacctgtaatcccagctactcaggaggctgaggcaggagaattgcttgaacccaggaggcggatgttgcagtgagctgagatcgcaccactgcactccagcctgggcgacagcgtgagactctgtctcaaaagaaaaacaaaagtttgatctactaaactaaattctctctccctcttctatatattaattattttatatatatatatattttttttaaatagatatggggtcttgctatgttgctcaggctggtctcaaactcctgggatcaagcagtcctcctacctcagcctcccaaagtgttgggattacaggtgtgagccaacacgcccatcctataaattaattattgtttgaagactgctctcctgttcacagctgtcttctccagctaaatatccaaatctcttctaatggttaccacagggcgtgattccatgtctccccacccactggtcactttgtggttttttttgtgtgtttttttttttatttttttgttttgagatggagtttcgcttttgtcgcccaggctggagtgcagtggcatgatctccgctcactgcaacctccgcctcccaggttcaagcgattctcctaactcagcctcccgagtagctgggattacaggcgccttctaccacgccgggctaatttttgtgttagtacagacggaagtttgctggtctcgaactcttgacctcaggtgacctgcccgccttggcctcccaaagtgctaggattacaggcatgagccaccgcgccaggccccactggtcatttttggaagtatagtttggccaatccagagggggcaggaacatcattcccctgttgtagatgctgcagcttttggtggccatctgtctgccaccatattcactaccttaatagccactgtctattgttaacttctgttgagttttcagcagggttcaagggaatagatcaatctttggagcagaaagacctgggccccaaatctagttttgccgtgtactagtaccctctatgctccttttatcatggagaatgtgatatccaggtactgttacagtctactatagcgtatgaagaggatctgtccccgcttatcaccagtctaattcagctggaggtggaaaagagcctgatctatttggctaggaacatccttgccttggagctgaataaaaatagccaaggtttattgtacatctaccaggtgctccattctagcgcctttaaacatatgagctcatgcaatcctcagaacaattcttaaaaataaattcttaaaaaaaattaaaaactcttaaaaataaagaggtaatcccattttcaggtgtggaaactagcttaatacagaagtaaagtaacttgccccatgtcacatggctaataaatagtgacagcaagaattcaagcctaggtcatctagcttctaacctggccctaaaaaattccactacactgcctccttacaaacccaggcatgacacagactgactgcaccacccgcacagctctgcagacacctccccagggaagaatttctattcaagaggtacagggaccatctaggtggaaccatttgagaagatctagtatctgagggatctattttttttcacttcagatttaagttaatttcaaaatttggattcatattcctatgtggggaatcccagatatttctttcttttctttcctttttttttttttttttgagacggagtttcactcttcttgccctggatggtgcaatagcgccatctcagctcactgcaacctccacctcctgagttcaagcaattctcctgcctcagcctcccaagtagctgggattacagccatgcgccaccacgcccagctaatttttttttttttgagacggagtctctctgtgtcactgaggctggagtgcagtggtgtgatgtcggctcagtgcaacctctgacaccagggttcaagcgattctcctgcctcagcctcctgagtagctgagattacaggcaagtgcgaccacacccggctaatttttgtatttttagtaaagacgaggtttcaccatgttggtcaggctggtctcgaactcctgacctgatccacccgcctcggcctcccaaagtgctgggattataggcgtgagccaccgcgcctggctagaatcccagatacttctaaaaataagagtttgtagtacaactgatgctccagaaatctgggtaccatttgacagaaatgcagtgcattcatattgtccctgcaagctagctcatttgcttaaatttccagaatgcgtacctacctttgataaggagagttattgaattgataaaattatcgtatgaatgtatatatattaaacattgtttctgggccgcatggcaaaaccctgtctctacaaaaaaataccaaaaaaaaaaaaaaaatgccaggcatggtggtacactcctgaagtcccagctacttgggaggccgaggcgggaggatcccttgagcccaagagtttgaggctgcagtgaaccgtaaccatgccactacactacactgggaacagagtaagagcctgtctcaaaaataaataaataaatacttcaaaaaaaaaaaaactttgtttccaaaatataaattagtcagtttggtttttcttatttgcatctttatctttctttctttttttgtagagacaggaccttgctatgtcgaccaggctggtcttgaactcctggcctcaggctatcctcccaccctggcctcccaaagtgctgggactgcaagcatcagccactgtaccccgcctcttatttgtatcttcttttgacatctgagcttgcaactctcacttatgtctgagtttcccttcctctatggctgggaccttaagcaataatacttctgataaactgtgcgccagatggccaaacattgcctaaaaaaaatgactaagaaagaggcctttgaaaagaacattgtgaagtggggatgactgatgatgtaaataggaaaaatgaacaaatgtgtgaagaaaacatttgcaaacagacgtctacatctaaatcccaagtcagcaaatctagtattcaggaaaaataccaaataggcagaaactttttggtttcttcagctttaatatacacagtagacaaattttcctttggtttggaaaatgttcctgccaaaacttgtatttcttatacatggaaatgtggtcaaggaggcagctgtacagtggttacatttgtgagagctggagtggcttcccttggttcatctcacacaatcccctaagtggtaggaagacccgtatcccagggctggggtgcccaggtgtcagagtgcggtaacgttcgctgagcacctatggtgtccaggtactgagctgggaacttatatttgtatcatcttactttggcccccaacaattctgtgaaacaggtatcatacctattttatagatgaataagtagaagtgtgaagaatataaaaggattggctgaaagtggcacagcttttaaatagcaagaccctaacttcagatctctgtgatttctgttttttttttttttttttaaataaatgttaagagatatagcaatggggatctcaccatgttgtccaggctggtctcaaactcctgggctcaagcaatcctccctccttagcctcccaaagtactgggattacaggtgtgagccaccatgcctggccaggtttctgtattaaaaccactttttactatatctcaggtatggaaatatgaaaacactgttgtagcaggcgggtagttgaagctctgcactcagggtaggctgacgtactgccaggctctgaccaggaccttacaacaatacccatccttggaaggtttgagtcaactttatagctgaatttgatgccaggagcacaaagcaaaagatccccatatataaagacaaggttataaggtacagtgtgcctggtacaactatcttccagaatgcttcccagaagtaacatagctgggcaccctggcacatgtttatactctcagctacttggaggtgctgaggcaggaggatcatttgagcccaggagtcagaggccagcctgagcaacatgctacgaaggggggcaggcttctctgataaggtcgagcccaagtaggcaatgagagcagagaattccaaagggagagacagttctgggcccgtgagccaatcctgctagccaggtcccctccaaccccctattccaggcagaccacttctgtgtcaaggtctgaaatccagccttgactttattttatttatgtattttttgagacagctctgctgtacaggccagaatgcagtgacatgaccatagctcactgtaacctcaagcgatcctcctgcctcagcctcccaagtagctggaactacaggcatgtgccatcacacctgtcaaattttaatttttttttgtagagatggagtctcactgtgttgccccggctatttttgaacccctgagatcaagggatcctccagccttggcctcccaaagtgctgggattacaagcgtgagccaccacgctgggctaatttttaatttttttttgtagagacaaagtctcactatattgcccaggctattcttgaactcctaagctcaaaggatcttccagcctcctcggcctcccaaagtgctgggattacaggtgagagccagcatgcctggctctagccttggctttattaaggtacaggcaggttttcctgcaggtagtaagatgaataaaggttagattggttttgagatccagatagaggctagactctagcctagcgcttctttttttttttttttttttgagacggagtcttgccctgtctcccaggctggagtgcagtggcgtgatctctgctcagtgcaacctccgcctcctgggttcacgcaattctcctgccccagcctcccgagtagctgggattacaggcacatgcctccacacccggctaatttttgcatttttagtagagacggggtttcaccatgttggacaggctggtctcgaacttctgacctcatgatcacctcagcctcccaaagtgctaggattacaggcatgagccaccacacccagcctagcctagtgcttcttaaacattcatgtgagctccatgcagtgtcacatctataatcccagcactttggaggccaaggcaggaggattgcttgagcccaggagtccaaggctactctgagctatgattgtgccactgcagctaagccttgactacagagtgagaccttgtttcttaaaaatatatatattcatatacatatattatttattttcatttattatttatttatttatttttgagagagaaagagacgaagtttcactcttgttgcccaggctggagtgcagtggcgcaatctcagctcactgcaacctccacctcccgggttccagtgattctcctgcctcagcctcctgagtagctgggactacaggcacccaccaccacgcccggctaatttttgtattttttgtagagaaggggtttcaccatgttggccaggctgatctctaactccttacctcaagtgatccacctacctcaacctcccaaagtgctgggattacaggtgtgagccaccatacccagcccttgaaaatatttttttaaagaaactttaatgtgcagataagtcccatggaggggacgtgttaaaatgcagattctgattcagaaggtctggtgggggtccaagacggtgtttctaacaagctcctaactgatacccaggctgctgctggtcttagaccaacccttgagtagactttagaggaagaagtttttattagctgtttctacaacactccccacagaaagggcaccctgtgtggccagctggcatgaaagcggtttctgcttggcagctatttttaggtagctgtaatgcattctattttttgcattctaagcttttcagtggaccagggcgatccctggggctgtcccagcttcagcaacggtccctaagaccattcagctactttgcagccactgcacaactgccaaacaatccactaatcctgatcttgaaacaattttccctcctgagaagacaccagacctcagcaggaagacttggcctgcacagcagttctcttaccccacacgaattaataaataggcctcatgaatcgggattttgtgcccttgggtagcgaattacctgatgactctggtgaactgacgaaactgagtttgtgaaactgtgagccggaagaacagtctacagctgtcgtggactcccctgaacccctgggaagacgcagctcaacagccagtccacacgaaccctgctctgaaacctctcctgcagactgggcctgggctagagaagaacaggagttttcttttctccttttttttgagacggagttttgctcttgttgcccaggctggagtgcagtggcatgatcgtggctcactgcaacctctgcctcctgggttcaagtgattctcctgcctcagcctctggagtagctgggattacaggcgtgcaccaccacgcccaactaatttttgtaattttagtagagatggggtttcaccgttttggtcaggctggtctcaaactcctgacttcgagtgatccacccgcctcggcctcccaaagtgctgggattacagagatgagccaccgcgccaagctgtgaattgattttttagtgaaacttcagggagccaaggactttggcccccacagtaccatctggattattgggaacaggtgcaaaatatatagggccagcgaaaactctcaaaggaatgattgacattataaatttagagaggaaggactgccttcctttctgtgacaacagcactttaatgttccaaaacaggatgtccttggatttggttttaatgcttatgtatataaggttagctattgccaggagactgatacaattaatcagagtccatctctcccttccaggcacaccttcacttcgctgcagtttctcatggccataaatccattagagcaagaaacagcaagattagtagagggccataaatttagattctgggccattttacctgataagtctttttgttcttttctctttttttgagatagggtctcactctgtcacccaggctggagtgcagtggagtggccatggctcaccgcagcctctacatcccaggctccagccatcctacctcagcttgcagctggaactacaagagcacgtccccacccctggctagttgttttgtaatttttgtagagacaggatctttctatgttgctagggctggtctcaaactcctgggctccagtgatccacccaccttggcctcccaaagtgctggggtttcaggcgtgaatcatcatgcccagccagaaaccagtcttaaaagactgtatactataatgattctatttatatgacattctggaaaaggtgaaattatagagacctaaaatacatcagtggttgccagaggcttggagaatgaagtataggctgaataggtaaaccatatatgatattttagggcagcgaaactcttctgtatggtacatgagactgcatttttcaaaacccatagaactggctgggtgtggtggctcacgcctgtaatcccagcactttgcgaggccaaggcagcggatcacttgaggtcaggagtttgagaccagcctggccaacatggtgaaaccccgtctctactgaaaatacaaaaaatagctgggcatggtggtgggtacctgtaatcccagctactcagtaggctgaggcaggagaatcacttgaacccaggaggcagaagttgcagtgagccaagatggcacttctgcactccagcctgggcgacacagtgagacatcatctcaaaaaaaaaaaaaaaaaaaaaaaaaaaaactttagctggctgagcggcacgcgcctgtagtcccagctactcaggaaggtgaagcaggaggatcccttgaatccaggagttcatgagctatgatcatcccacagcactccagcctccgtgacagagcaaaaccctgtcactaaaacaaaacaaaacaaacaaacaaaaacccatagagcacaaatttctctacagcacaaatttcaaccttaatatatgcaaatgttaaagcgggagtgggagggttcccaggatggaatgcaaactgttataaagaacctcaccatgctacaaacatgacctaacatccaaggggaaggaagggaagtgctgggtgttgaaggggatggaagggaagtgctgggcattgaaggggatggaagggaagtgctgggcgttgaaggggatggaagggaagtgctgggcgttgaaggggagggaagggaagtgctgggcgttgaaggggagggaagggaagtgctgggtgttgaaggggagggaagggaagtgctgggtgttgaaggggagggaagggaagtgctgggtgttgaaggggagggaagggaagtgctgggtattgaaggtgagggaagggaagtgctgggcgttgaaggggagggaagggaagtgctgggcgttgaaggggagggaagggaagtgctgggcgttgaaggggatggaagggaagtgctgggtgttgaaggggagggaagggaagtgctgggcattgaaggggagggaagggaagtgctgggtattgaaggggagggaagggaagtgctgggtattgaaggggagggaagggaagtgctgggtattgaaggggagggaaaggaagggaaatgctgggtattgaaggggagggaaaggaagtgctgggcattgaaggggatggaagggaagtgctgggtattgaagaggatggaagggaagtgctgggtattgaaggggagggaagggaagtgctgggtattgaaggggagggaagggaagtgctgggtattgaaggggagggaagggaagtgctgggcattgaaggggatggaagggaattgctgggcgttgaaggggatggaagggaagtactgggcgttgaaggggagggaaaggaagtgctgggcattgaaggggagggaagggaagtactgggtattgaaggggagggaagggaagtgctgggcattgaaggggatggaagggaagtgctgggcattgaaggggatggaaaggaagtgctgggcattgaaggggatggaagggaattgctgagcgttgaaggggatggaagggaagtgctgggcgttgaaggggagggaagggaagtgctgggcgttgaaggggagggaagggaagtgctgggcgttgaaggggagggaagggaagtgttgggcgttgaaggggatggaagggaagtgctgggcgttgaagggggtggaagggaagtgctgggcgttgggggtggaagggacgtgctgggcgttgaaggggatggaagggaagtgctgggcgttgaaggggatggaagggaagtgctgggcgttgaaggggatggaagggaagtgctgggcgttgaaggggatggaagggaagtgctgggtgttgaaggggatggaagggaagttctggatattgaaagagaaggaagggaagtgctgggtattgaaggggatggaagggaagcgctggtctaagtgactttggaaataagtgaagactataagactaaaaataaaaggaactgtacataagcactgaactctaacagcaaaattgtttcccatggggatatgggttaacaactgtgaaaccactctacattgtgctgggattgaatggatggcaagccagggagccaggtagctcaccgttgtctacacacacacacacacacacacacacacacacacaattctctcttgcttatattaatgtgtatataaatatacatacattaacaactgtgtgtgtgtatatatatacacacatataaatatatatgctaataatcatgtatgtgtttatgtgtgtgtatgtattatacaagaatcatgtatgtgtgttacatacatgatagttaatgtatatatatttatatgtgtgcaccagttagtacacacatataaaaactacaaagcaagtcggccagacatggtggtttatgcctgtattcccagcactttgggagaccaaggcaggaggattgcttgagcctattagttcgagaccagcttgggtaacttgacaaaaccctgtgtctacaaaaaatacaaaaattagccaggtgtggtggcaggtgcctgtaatcccagctcccgaggaggctgaggtaggaggatcacctgagcccggaaggtcaaggctgcagtgagctatgatcgcaccactgcactccatcctcggtgacagagtgagaccctctctaaaaaaaaaaaaaaaagtctgaaaaagaaaacacaacaagtatagagaaagtcaagaaaactgaagttgtctttttgaaaagaccaacaaaactgacaaaacagtctggcgctcacgcctgtaatcccagcactttgggaggctggggtgggaggatcacttgaggccaggaattagacaccagcctgggcaacagagcaagactcctgacccccaagtctctacatgaatttttttgtttgtttgtttgtttgagatggagtctcactctgtcgcccaggctggagtgcccaggctggagtgcagtggcgcgatctcggctcactgcaacctctgcctcccgggttcccgccattctcctgcctcagcctcctgagtagctgggactacaggcacccgccaccgcgcccggctaattttttgtgtgttttttagtagagatggagtttcaccatgttagccaggatggtcttgatctcctgacctcgtgatccgcccacctcggcctcccaaagtgctgggattacaggcgtgagccaccgcgcccggccgaaaatttttaaaaattaggcatagtggaaacctgtagtcctagctacttgggaggctgaagaaggattgcttgagccgaggagtgaccaatgatcaagccactgcactccagcctgagtggcagagtgacaccctgtctcgattttttaaaaaactgacaaatcttttgctaaactgaccattttaaaaagagaaaaagtggccaggagggtggctcacgcctgtaatcccagcactttgggaggccaaggcaggcggatcacgaggttaggacatcgagaccatcctggccaacatggtgaaaacccatctctactaaaaatagaaaaaaaattagctggacgtggtggttggcacctgtagtcccagctactcgggaggctgagccaggacaatcacttgaacccaggaggtggaggttgcagtgagctgagatcgtgccactccactccagcctagcgacagagcaagactctctctcaaaaaaagaaaaaaagttcaatatatgaaaatcagcaattaaagaggacatcactatataccttacagaaaaaaaaataaataaaaggtggccaggtacagtagctcatgcctgtagtcccagcactttgggaggctgaggcaggcagattgcttgagcccaggagatctgttgtccaggagatctgagatcagcctggacaacatgacaaaaccccatctctacaaaaaatacaaaaattaggcaggtgtggtggcacaggcctgtagtcccagctactcagggaggcagaggcaagaggatggcttgagccctggaggttgaggctgcagtgaaccctgacggtgccctgcactgcagcctgggtgacaaagtgagatcctgtctcaaaaaataaataaataaaaatagattataaaagaataccatgaataaccatatgccaacaaattagataacttatataaaataaaatgggcacattccttgaaagacacaaatttctgaaacagacagaagaagaaggagaatatctaaatagacctatagacctacagcaagtaaagagattgaattcatactgacagtggctcacacctataatcccagcacttttcaaggccgaggcaggaggagcacttgagcctatgagttcaagtccagcctagacaatgtagcaagacactgcctctaatacaaaaattaacactaaaacaacaaaaacactcaacaaactaaaaggagctacctcaatccaataaagggcacatacaaaaaaacctacagctaacaaagtgaaagactttctccctaccaaaacaaagatgtccactctcacctgttcaacactgtgaaggaggttctagccaaagcaattagacaagaaaaagaaacaaacaggctgggtgcggtggctcatgcctgtaatcccagcactttgggaggccgaggcgggtggatcaacaagtcaggagttcgagaccagcctggccaacaaagtgataccctgtctctactaaaaatgcaaaaaattagggggtcgtggtggtgggtgcctctaattccagctaccaaggaggctgaggcaggagaatcccttgaacccaggaggcagaggctgcagtgagctgagatcgtgccattgcactgcagcctgggcaacacgaatgaaactccatctcagaaaaaaataaaagaaaaagaaacaaaaggtattcagattggaaaggaagaattgaaactatctctgcttataaatgatatgattttatatagagagaatcctaatgaatccaacaaaaagctactagtatttacatgtatatttcccagctctgtccacttagaggccccagaaacaatatccaggtagcaatgagaacacacccagtgtccagatctcggtttctaataccattccccagagcagaggaccctggtttctcataccattccccagaacagaggaccctggtttctcataccattccccagtagagaggacactgctttctaataccattccccagaacagaggaccctgctttctaataccattccccagtacagaggaccctgctttctaataccattccccagtagagaggaccctggtttctcataccattcgccagtgcagaggaccctgctttctaatacgattccccagaacagaggaccctggtttctcataccattcgccagtgcggaggaccctgctttctaataccattccccagtagagaggaccctcgtttctaataccattccccattgcaaaggaaccagcctccctggagaaatgcctgatttctttttttattttttgagatggggtctcgctcgtcatcaggctgcagtgcagtggcgtgatctcggcttacctcaacctccgcctcctgggttccagcgattctcctgcctcagcctcccgagtagctgggattacaggcgcccaccaccacacccagctaatttttgtatttttggtagagacagggtttcaccatgttggccaggctggttcaatctcttgacctcatgatcttcccgcctcggcctcccaaagtgctaggattacaggtgtgagccacactgcccggccctgatggttttgttgttttttttttttttttttttttttttttagtaaataaacttgtaccagaagaaatggctgattctaagcctgggtcaggaaatatccaatatgaacctggagcatcttctagtgccagaaagtacgaaagagctcaaagaacaaaatggtggggatatgtctatggacacagaagccaactacagaagctcccaatggccaaagctggagcaatttatactacagaatgaagagcctaatacagattataacccaaagtataaaaaataaatatccatgagaccccactgccataaataagtgattgcctaaacaaataaatgaggacgaataggcaactctcttgtacagtggaactctagatgatatactgacatttatcatggaggaggtggggcataactccctaccgctgaggcaggagttgcatagagtgacttcctactaaagagtatagtacggaaagcggaggaaaggccgggcacggtggctcacgcctataatcccagcactttgggaggccaaggcgggtggatcacgaggttaggagttcaagacaagcctggccaacatggtgaaaccccatctctactaaaaatacagaaaattagccaggcatggtggcaggtgcctgcaatcccagctactcaggaggctgaggcaggagaatcgcttgaacccaggaggcagaggttgccgtgagccgagattgcgccattgcactccagcccgggcaataacgcgagactccatctcaaacaaacaaacaaactaaaaagaaaatggcactttatctctgtggttttcctccccaaaaccccaaaccccaaaccccagtctaatcatgagaaaaacatcagacaaatcccagttgaaggacattctacaacatgtatgaccagtactccttaaaaccgtcaagttcatttaaaaaaaagaagggctggacgcggtggctcacacctgtaatcccagcactttaggaggccgaggtgggcggatcacctgaggtcaggagttcgagaccagcctggccaacatggtgaaaccccgtctctactagaaatacaaaaattatccgggtgtggtggctcgaacctgtagtctcagctacttggggggttgaggcggtaggattgtttgagcccaggaggcaggggttgcagtgagctgacattgtgccactgtgttccaacctgggtggacagagtgagaccctgtgtgagaaacttacattttattttatttaggtatttggttttgggattacaggcatgagcctccgcgcctggccgaaacttacatttcagaagagcgtaaggagacctaatgactgaatgtgatatggcatcctagctgaaatgctagaaatagaacactgggtaagaacgaaggtaacccaaattatgtatggtcttcagaagactgtatgaatattgactcataggttttgataaatgtaccatagtaatgggataacaataggagaaactgagtgtatgggtatatggaaactctatatttgatcgattgattgattgagatagggtctcactttgttgcccaggttggagtgcagtggtgtgaacatgactcactgcaacctcaacattccgggctcaaaacatcttcacgaagctgcccaagtagctgggaatacagaagcatgccttgccagtttttacaatttgtgaagagatggggtttctttgttttctttctcttttttttttttttcgagacagagtctcactctgtcacccaggctggagtgcagtggtgcgatctcagctcactgcaacctccgcctcccaggttcaagcaattcttctgcctcagcctcccgcgtaactgggattacaggcgcccgccaccacactcagctaatttttatatttttaatagagatggagttttgccatgttggccaggctggttccaaactcctgacctcaggtgatccacccacctcggcctcccaaggtgctgggattacaggcgtgagccaccgggcctggccgagatggggtttcaacatcttgtccaggttggtcttgaactcctgggctcaggtgattttcccaacttgccctcccagtgtgctgggattatagtcctgagcctccaggcccagccatctctacactatccttgcaaattttttgtaaatcaaaaatattctaaagcaaaaatttattgagaaaaatatacacatacatatcacatgtacacacatacacatagttgcagaaaagggaacagaagaaaaaatagtttaaaaaacctttttgtttttccattaaatattctttaataaatatgtactactttgaacataaaaaatgcttttctttaaactatgagaatagaaaatgcttatttgtttgaaatgtaaccctggctttctctttctactgtattctacccattactattctatattttgtattttattatattattactatttttgagacaggatctcactctgtcacccaggctgagtgcagtggcatgatcacagctcactgcagccttgacccccccaggctcaagtgatcctcccacctcagcctcctgagcagctggggctataggtgagtgacaccacacctggataattttttgttttttgtagacagggtcttaccatattgcccaggctggtcttgaactcctgggctcaactgatccttccacctcagcctcctgattagctgggactataggtgcgtgccaccacatttggttcatttcttatgttttgtacacagggtctcgccatactgcccaggctggtcttcaactcctgggctcaagtgatcctctcacctcagtctcccaaagtgttgggattacaggtgcgagccgctacgctcagccttttttatttttatttatttatttatttgagtcagaatctagctctgtcacccaggctggagtgcaatggtgagatcttggctcactgcaacctccgcatcccgggttcaagcaattctcctgcctcagcctccagagtagctgggattagaggtgcccgccaccactcccagctagtgtgtgtgtgtgtttagtaaagacaaggtttcaccatattggtcaggctggtcttgaactcctgacctcgtgatccacccacctctgcctcccaaagtgctgggattacaggggtgagccaccacacccagccagcctattttattttattttattttgagacagggtctcgctctggtgctggagtgcagtggcatgaggttgcttactgcagccccaaccttttgcgctcgagtgatcctcccacctcagccttctgagtagctgggatcataggcacgtcctaccatgcccagccaatttttagttgttgtttacagacacagtgtctcttcctaatgcagtctcccttagtatctcactggtctttaagtaaaaaagaaaaaatttaaaaattggaataacaaaagatatgtggtctccctgtgttccccaagctggtcttgaactcctgggctcaagcaatcctcctgcttcggcctcccaaagtgctaggattacaggtgtgagacactgcacctggcctactcttctataataagagtctcatctttctcttatgttgaacgtgatacagatactgggttctttttaacttttttttttatttgagatggagtctcgctctgtcgcccaggctggagtgcagcggcgcgatctcggctcactgcaagctccacctcctaggttcacgccattctcctgcctcagcctcccaagtagctgggattacaggcgcccgctgccacgcccggctaattttttgtatttttagtagagacggggtttcgctgtgttagccaggatggtctcgatctcctgacctcttgatccgcccgcctcggcctcccaaagtgctgggattacaggagtgagccaccgcgcctgtcatctttttaacattttttaaggaattcttatttgccatgagccaaggaatgcacagagactagattcccatggacagctcactcctaccgaacacatacaatgggacacacctgtgctgggtgaaaggcgcagcctagagggctggcaggtgttgggtgaggctcaggtttcaggctgaggggaggagggtcagctggcagatcctcagcaactctggcagcctcacagggccacagcccccctggagctcttggttcccccagggtcaaaccaggtctcagtcatggagctaggatcaagctttcctaccctcctcagtaggaggcccccttcttcccaggagggagagctaggggaagggagatagtggagggtgagggaacggcattcgcatttgtaagcagtgccctggagctgcatgctggagataagagaaggcccctcccgaggctgggagcagagggagctgcagcctgaggcttgggcaggacaggtgaacccaggtttcccaaccactgaatcaccctttgccccaccacgcacatgcgctcttgcgtgtggacgcacgtgcacacacacgcacaccccacagcttccacgtggcaatgtgtctaagcccaagatcctggacagcccagacacagaactgccatgagaacccacagcagtcccactcgggagccctcatcagcactgctgagtgccaaccgaacaacagtgagaacgagaacacagacccttatcctgggaccacacagttggcttctcaaggcttcatgaaattcttctttttattttttctttgagacacagtcttgctctgtcacctaggctggagtgcagtggcgtgatcctggcttactgcaacctctgcttcccaggctcaaacaattctcatgcctcagcctcccaagtagcagggactacaggcatgtgtcaccacacccagctaattttgggggtattttttcttcttttttttttgagacagagtctcacaccatcacccaggctggagcgcagttgtgcgatctcggctcactgcaacctctgtctcccagcttcaagcaattctcctgcctcagcctcccaagtagctgggattacaggcacctgccaccacctgctaattttttgtatttttagtagagacggggtttcactatgttggccaagctggtctcaaactcctgacctcgtgatccacatgcctcagcctcccaaagtgctgggattacaggcatgagccaccgcgcccagcctaatttttgtatttttagtagagatggggtttctccatgttggccaggctggtctcaaactcctggcctcaagtgatccgcccaccttggcctcccaaagtgctgggattacaagtgtaagccactgtgcctggcctaaattcttctttagcatcatgcaatctgccttaattgagaaatgttatcacgaaaacccacatgaaactcaatattgcacttactgtaggagctattattggaagctagtgatcctgagaacttgcctagagtttcagtgcaagaaaaggctggcttcggctgggtgcagtggctctcgcctgtaatcctagcactctgggaggccgaggcgggtggatcatgaggtcaggagatcgagaccatcctggctaacatgatgaaaccccgtctctactaaaaatacaaaaaaaaaaaaaaaaaaaaaaaaaagctgggcatggtggcgagtgcctgtagtcccagctactcgggaggctgaggcaggagaatggcgtgaacccgggaggcggagtttgcagtgagccaagatcgtgccacggcactccagcctgggcgacagggcaagactccgtctcaaaaaaagaaaaaaaaaagaaaaggctggcttctcctgattaatggtcatcttatttttgacacaatttgtaataacttttttttttgagacagaatcttgctctgttgcccaggctggagtgcagtggcgtgatctgggctcactgcaagctctgcctcctgggttcacaccattctcctgcctcagcctcctgggtagctgggactacaggcacccgccaccatgcctggctacttttttgtattttttagtagagacggggtttcaccatgttagccaggatggcctcggtctcctgaccttgtgatccacccgcctcggcctccccgagtgctgggatcacaggcgtgagccaccgcacctgccacgtagagcctattttcttatccataaaacaatacctacttcacggggttgttctgaggattaagacaatctatgtaaaataattagccaatacacaacctatagcatgctcagtaaatggtagctggtataacaattatgggtttcttgtttgtttttttgtttgagatgcagtctggctgttgcccaggctggtcttaaattcctgggctcaagcagtcctcccgcctcggcctcccaaagtgttgggattatgagcacgagccaccacatccggataaaggaagtccctgtccgggatcacctgaggctaaagagagctgcgtcacccaacgtcatgctccccctagggacagctgcattcctgacaagggccatcccagctccagagagtcactcctattgagagatttgctgaggcctttgtttcctgagctccaggccgacgtcccctaatcctgcagccctgcctcctcacaggtattaatcctgagggcattttttttctttctttttgggcggggggcggggggggcacgaggttttgctcttactgcccaggctagagtgcaatggcacaatcttcactcactgcaacttccaactcccgggttcaagcgattgtcctgcctccgcctcctgagtagctggggttacaagcatgcgccaccgcgcccagctaattttgtatttttagtagagatggggtttcaccatgttggtcaggctggtcttgaactgctgacctcaggtgactcacccaccttggcctcccaaagtgctgggattacaggcatgagccacagtgcccggcctcctgagggcatctttaataaacttcctgatcacaaatctccctcttggtctgcttcccagacacccaacctctgtctgttgtaaggagaggttattaaatggccctgtctctgacagtctaatgtatttctctccacaatggcatgtaccctcctagttcccctgagagtacactgtcttcttggggatgcatctagacctggtaatttctagaaactgatcgaagttagagactgggagaaaatacagaaatcctaatcctggccgggcgcggtggctcacgcttgtaatcccagcactttggaggccgaggcgggcggatcacgaggtcaggagatggagaccatcctggctaacgcggtgaaaccccacctctattaaaaatacaaaaagttagccgggcgtggtggcgggcgcctgtagtcccagctattcgggaggctgaggcaggagaatggcgtgaacccgggaggcggagcctgcagtgagccgagatcacgccagtgcactccagcctgggccacagagtgagactccgtctcaaaaaaaaaaaaaaaaaagaaatcctaatcgttcctgcaccaattcccatccttacttcctacttcgccctgcccaaatgaaaaaatacaaaaattagctggtcgtggtggcgggcacctgtaatcccagctactcgggaggctgaggcaggagaatcgcttgaacccaggaggcggagcttgcagtgagccgagatcgcgccactgcactccagcctgggcaacaaagagcaaaactccgtctcaaaaaaaaacacaaaagattacaactccaagaccagcctgggcaacatggtgaaaccctgtctcgacaaaaacacagacattagcctggtgtggtggtgtgtgcctgtggtcccagctattcaggaggctgaggtgggaggcagaggttgcagtgagccaagatcatgccactgcactgtagcctgggcgatggagcgagaccctatagtaacaaaacaaaacaacaacaaaaaaattccacaaacgactaaagaggaacaaaccaatcagacttctcagaagtacttggcactgaacttttcaaaggatccttaccaaaatcgagcttttttgttttccctctgaagtctcatgttaagcaagaggggaaaacccagtgtctgcctggggtaagaaaagtcgcaaaagtcttcaaaggtcatcaaggttttaaatgttcacagtaatgagtttcttttttttttcttttttttttttgagatggagtcttgctctgtcgcccaggctagagtgtagtggcatgattttggctcactgcaacctccacctcctgagttcaagcgattctcctgcctcagcctcccgagtagctgggactacaggcacccactaccatgcccaactaattttttgtatttctagtagagacggggtttcaccgtgttagccaggatggtctcgatctcctgatctcatgatccacctgcctcggcttctcaaagtgctgggattacaggcgtgagccaccacgcctggctccaagtttcttcatggagctctatctgcaaggatctgagtcgagagggcacacacacaggaggcaaattcacgacctgaaccaaggcccattctcctgagagactttcaggtcactgacgtagctacagatattggaaaaaaatgcatctgtagtagttcagttgaggagaggggatgggtggcagtaaatcttaaggggctcaggggcatctattccaaatttccagagagggtcctcacagtctgtcattgcatatacatcaaatgtaaatgtatccttaggggggtttttggttttgttttcagagacagagtctcactctgttgcccaggctggagtgcagtggtacaatcacagctcactacagccttcaactcctgggctcgagggatcctcgcacctaagcctcctcaggagctgggactataagggcatgggccaccacacccagctaatttttaatttttttatttgtgatatggtcttgatctgtcatccaggctggagtgcagtggcatgatcacagctcactacggccttgacctcctgggtccacctcaacctcccaagtagctgggactacaggtgcatgccatcatgcctgtgtttcattatatatatatatgttgagagagagagagagagagagagagagagagtagagagagagagtagatatggggtttcaccattttgcccaggctggtcttgaactcctgggctcaagcaatcctcttgcctcagcctcccaaagtggtgggattacaggagtgagccaccacacccagagaatttttaaattttttgtggcgatggagtctcgctctgttgcccaggcttgtttcaaactccgagcctcaagcaatcctcccaccttggcctcccaaagcactgggatgacaggtgtgagacagcatgcccaggcatgaatgtgtctttaaacataccttttactttctttttttttttttttaactgtagtcataatagctatttacttgggtaaaattttctcaggatatttttggtatgtggggcagagggagagctagcaagtgagagaagctgtcttttcagtacaaagagctcacagtactccggtctccactggaagttccgtctttatttttaaaggaatctggtcatgagtctgttgaccaagcacatcctggtaatctattgtcagatgagaagtgttctggatttccaacttataccatgcatgatagatgctgagtttcaagcataaaactactctagttaccaagatcatactgcttttatgttgatataacttaattttattatttgcttcacctcccaccagaatcacttatttgctcacttttcttgtctatgctctagaatgcacttactgcttaagcggcatattatatgaaccatccttttacattatagtttattaaaaagtggcttttgccgagtgtggtggctcacgcctgtcatcccagcactttgggaggccgagacaggtggatcacgaggtcaggagatcgagaccatcctggctaacacagtgaaaccccgtctctactaaaaatacaaaaaattagccgggtgtggtggcgggcgcctgtagtcccagctactcgggaggctgaggcaggagaatggtgtgaacccgggaggcagagcttgcagtaagccgagattgcgctactgcactccagcctgggcaacagagcgagactgtctcaaaaaaaaaaaaagaagtgtcttttcttttttcttttttctttttgagacagggtctcactcacccaggctggagtgcagtggcgtgaacttgggagcctcgacatctgggctcaagccatcctcccacctcagcctcccgaatagctgggactacaggcacacaccatcacacccaccctgctaatttatattttgtagagacaggattttaccatgtttcccaggctggtcttgaagtcccaggctcaactgatcagcccaccttggcctcccaaattgctgagattacagacgtgagcctctgcgcctgcccaaagcagctgttcttttgcaaggatttattggtctgtggtgcctctccctcagtacccttgcgtggttcttttctttttttcttttttgtttactggagctacccaccatgaactattggttggttatttataaaaatatgtttaggtttatgcacatcattatatttatttgcccacgtgggccccttgagcatcagagcttcctaaagcaggatctttgcaggccatctcatccctcctcatcatgtatggatacacaaaccgaggtccattgagtccttttgaagaaggatagctgcagctagctgaaggccaaggcaggtggatcacttgagcccacgaggttgaggctgcaataagctgtgttcttgccactgagagagagactctgccttaaaaaaaagtgcaagctgcaaagtggttgccttttgctgaggaggtgggtactgggagcagcaggaattgactggaaagaggcatgaggacacgttcctttttttcccttttttattttttattttattttttgagacagtctcgctctgtcacccaggttggagtgcaatggtgcgatcttggctcactgcaacctccacctcccaggttcgagtaattctcctgcttcagcctcctgagtagctgggattacaggtgcatgccaccatgccaactaatttttgttcccttttctattttttacatgtaataattatatatatatatatgtatgtattttttaagtgctatttttgttgcattaagagtatggctccccagggaccacaaaggccttttagaagcctccgtatgtatttataggttatcaacaacaacaacaacaaaaaaacctctgctgaaacatacgcaatagtgatttaagaagaaaaggaatttttcacattggatgagaaagaacttcccaagttagttgcctttacaaattcaaacatgacgggctatcggcttggagtgttttttaagagtgacgatgggaggcttatggtaagcccattgtttgacgtgacccaagcatggcctggttaattttgaccatgctcacagcagtggtagaagcaactagccacacagtaccgtacttgttctgaaacacccatctctacttgtgaaaaagtagaggatcattgaaggatcttaagaaaaatttctggaccatagcatatctctgcagcaaaagaaaagtaacatatttgaatgtaaacaaaaacctgagactcacccccacaccccaatgctcaccacactcataagaaaggaagtgagaatgggaacccccaaaggcccacagaacctatatacaactgtctttctctgtgaaaacagatcagccccagaacctctatacgcctctctatgtgaaaacaataaatcagccccagaacctatatacacttgtctttctctgtgaaaacaatgaatcagccccagaacctatatacgcctctctttctatgtgaaaacaataaatcagccccagaacctatacacgcctctctttctatgtgaaaacaataaatcagccagagaacctatatacgcctctctttctatgtgaaaacaataaatcagccccagaacctatacacacctctctttctatgtgaaaacaataaatcagccagagaacctatatacgcctctctttcgatatgagaacaataaatcagccacagaacctatatatgcctctctttctatgtgagaacaataaatcagtcacagaacctatatacacctctctatgtgaaaacgataaatcagccaaagaacctatatacgcctctctttctctgtgaaaacaataaatcagccccagaacctatatatgcctctctttctctgtgaaaacaataaatcagccagagaacctatatatgcctctctttctctgtgaaaacaataaatcagccagagaacgtatatacgcatctctttctatgtgaaaacaataaatcagccccagaacctatatgcgcctctctttctatgtgaaaacaataaatcagccccagaacctatatacgcctctctttctatgtaaatacgatagatcaggatgccagaaaatatgtgattgtccccttcacattaccttcctaattaatgattcaaaactttagcaatccataattttattttttttccttatacagggcctaccctgcttctagataatcccacaacagatactaaataaaaccttacacaattgaattgaaggaagtaagctttgtttgtgtagtacctgagtgagtttagagagtacaaacattgcccataactgagtataatagatatcacaagcatcttccctatatcacctcaaacataaaaataaaatgccaggagatttaacgatgtgaatgggaaagtccaaattataagccttttagaaaaaaactaaatagaaaagtatcttattacgttgggatagtaaatgattttttcctttcccaccccccacttttttttttttttgttggcagcctcctgagccagagtaggctcagagactccagttttttgtgtttttgtttgtttgtgttttgagacagagtcttgctctgtcacccaggctggagtgcagtggcgtgatcttggctcactgcaacctctgccttgtgggtttaagcgattctcctgcctcagcctcccgagtagctgggattacaggcacccaccactacacccagctaattttttgtatttttagtagagacggggtttcaccatgttggccaggctggtctcgatggtctcctgaccttgtgatctccctgcctcatgatccctcaccctcccaaagtgctgggattacaggtgtgagccaccgcgcccggccctgtttttgtttttaagtagagatggacctcggcctcgcaaaatgctgggattacagttgtgagccaccatgcctggctggaagtgattttcaaaatcagacataaaatgtgcaagccatacaagaaaattattgataaattttattctattaaaactcagaattgatatttattaaaagattccataaagaaagcaaaaatcaagctacaaacattttaacatacataatcaaaaaattatttgcatacaaaatatgttctaattctttaaaccatttatgtgtgttatatacactattctgaaaacaaaaaccagcacccaagacagacaaagcgtgtggagctagtgtggctaagttgaggcgggaaattaatgctgcaacaaagttactgactgtctccaacctgttttgtggtgttacacatgggcataataatagctccttcctcataaggctctcggagctataaaccacagtgtgtctaaaataccttgcccagggtctggcgcatggcaagagctcaaccaatggtgaatggttggaactataaataaataatcgtgtcagagccgagtgggaatcaaactcagctccttaagtcctccatgacctagacaggattgttccagaccatgtggcagaagttaaggggccttggtgatgaaggcaagaatgcccacactgtttctcctgttcctccctctttctgtccctgaggcagtagctgactccaaactgagtctcccacacatatccagcagggctcagcctcagggaatccataggattctgggggtggacctttgggaggagaaaccatctcaactaagacactttcctctctcgtcagcaaagatattcagagatggatagccgacttacatttttattttcttcattaattaatttttttgagacaggttctctttctgtcacctaggctggagtacagtggcaagatcactgctcactgcagcctcaacctccggggctccagtgatcctcttgcctcagcctctcaagtagctgggactacaggtgtgatgcccagctaatttgtttgtttctttgggttttagtagagatgaggtcttaccatgttgctcaggctgactgttccatgtcagcctcgcagagtgctgagattacaggcatgagccaccatgctgggccaatttacattttttaataggagaaaccaacttggccctaactcaggtgcactgaaaccaggaactcttactctgaataggtttagctcatgagataaattcccccaaattattggctcattcgtaaattgtctttttttttttttttttttttgagacggagtttcgctcctgttgcccaggctggagcgcaatggcgtgatctcggctcactgcaacctctgccccacaagttcaagcaattctcttgcctcagcctcccaggtagctgggattacaggcacctgccaccacgaccggctaatttttttgtattttcagtagagatggggtttcaccatgttggcaagactggtcttgaactccagacctcaggtgatccacccgtctcgtcctcccaaagtgctgggattacagctgtgagccactgtgccggccctttttttttttttttttttgagatggagtctttctctgttgcccaggctggagtgcagtggcacaatctcagctcactgcaacctccgcctcccgggttcaagcaattcttctgcctcagcctcccgagtagctgggattacaggcatgcaccaccatacccagctaatttttgtatttttagtagagatgcagtttcaccatattggccaggctggtcttgaactcctgacctcgtgatccgtccgccttagcctcccagactgctgggattacaggtgtgagccactgtgccaaattgtctattttatcacaattacatttatggatgttaagtaagatacaaaatacaaaaataaaaaggaagggactgaacaacaacaaaaagaatgattagaaggaggctggattccatcaagcgggtccaggtcagatgctgggggctccacgggcccttctccatggaaggactgaacccaatgcccctccctgctgggacggtggagctaggaagcttttcataacaggcccagtgcttggtgcccatggaggctagagcaaaaaaccttcatgggccaggcgtggtggctcacggctgtaatcccagcactttaggaggccgaggcaggcagatcacctgaggtcaggagttcgagaccagcctggctaacatggtgaaaacctgtctctactaaaaatccaaaaattggctgggcatggtggggtgcatctgtaatcccagctactcgggaggttgaggcaggagaatcacgaacccaggaggcggccaagatcacaccactgcactccagcctgggtggcagagtgagattccatctcaaaaataaaataaaatatttaaaccttcatgggatgagcagagacagccctgttcacccgttcttattgaattttgtgtcttagttttttattccaaaagcataatgtccacgtccatttcattctaagacactttgaggatttgtttgtgtcaggagcgcttagggccaggaggtttggttcctcttcaaaacactgagggaatgtggacttactgtagataagatttgggcgaagcagctccgacccgaaggacacaggccacgcagtcctagtaccccacagagccagcggccaggcatgagtcccagggatgggggcagacgccgcatccaccttgtgtcctaggagggatggggcacacgccgtatccaccttgtcgccctctcacagtcaagggctagagagcagaacccagaagtgggggccacgctgggtcccccagcctgtaggttggcatggggcttcctcagggactaagggagacccagaggtgaaagccaagaaatagcccccctctctcgtcctcttccaccctaactgaccccttggctcccagcccaggcaggcgcccgggaagaataagggctggacacgtgcaagagaaaaggaacatccaggctgcatctcccatgcggacagctgacaggaagccagaccgaagatcaagaagggggcaccctagtttccccaaacccacatggcaaataactgcaggccttctgcaggaagtgtcatgaaaggaagctgacccgcagaatcatcggctggtataataactgccttcctgtgagccactgctaaaattctgccactcttccagtctttaagccacacaagcattgccttctaagccaagggaagaatttactgtatcaggaaaatgtattgcaacatcattctcaggattaacatgtctctttaccttagatctttatttatctttctgccaggtgaccaaagtaggacctgaagaattatcctcacactctatcacaaaaaaaaaaaaaaaaaaaaaaaggctactgagctgagtggggtggtgcagccctgtaatcccagctactcaggatgccatggcaggagcaatgcttgcgtccaggagtttgagatcagcctgggcaatatagcgagaccacgtctctaaaaataaaaataagttactgtggagaatgaatgagtggctaatcccgtgttttgctgagggtttttagatgaccccaacttctcagaacctggctccgaagatcagtcatccccacagccagcccatgaccgtctctgcagtagggtgagctggcctttgggtggcttttggggaaactgcctttagctctacatgccacaaggatttgtaaaagcagctcccaagcaaaaccggagagcaaaacttgaggctccacggaagatacacgaccaacgccctgttccaggtaaacgtaaggccaggccagggtctcccatgtccccctacccaccagacctacacggaagatagcgccatggaagtggcatccagacatcgaaggggcaggagtcagggtggccccatctctccagcaggcaggagggccatgggggtcctggctgcaaagaggccaaggcccctccacttggagaggccttcagtgcccatttcagcagcctcgtccagtgctcctccagcttcagtatgtgcctgagtccccttggaatcgtgttaaaatacggactctgcctcagtggttttggggtggggcctcaggtgcagcctccgtgtcccagtcaacagttagggccaccatacttagcggcaagtcatctactcataggtaagtggtcagtaactaaggaggaccagtcaggccggatgcagctggaatatttctccccatcaagattcatggaacaaataatgatagcgaacaccaagaaagcacaaccaccgctctacaccctttacatgaactcatttaatcttcaaatccgccccaagaacaggtgactaatattatcctatttacagatgagaaaaccaagcacagagaggtcaggagactcacctaggctggtgagtagcaagctgggatttgaacccaggccacctggctctggagttgtgggtcttgacagatcccggtacttctgtacactggggctgtagaatgtgagcagttgcgcaagactcaggatggagtgtgttgtctcggccgggctgagacaaacatgtctgtgatctattatcagaatcttttcaaactatgatgagctctccaaagtttgtttcaaaatactgtaagccttccccctcaccaggcttggcccagaaaatatcttttatcgtcaaacgacttcaaaacttgtttgtattttaatagaagcttagtttcttaggaattctgaaacagtgtttaaaataatcagtatgggcttcaggaattttatcttgaacttcctcactctggggcacaggttgtattcatgtgcttcaaacgttgttgatctgtcttgtctgagtttgtggggaaacggggccgtgttaacctctcgtttgttgtttgatccatggccgtgtgtggtcacgggaggaactcgtggtggtggggctgatcgctggttcaaggatcagaataagaaggttccagtgctgctctgtctccagtttgctgtgtggcctgatcggcttatagcccttctcggggcctcagtttccccatctgtaccatgaaaggtctggctagatgctccgaagtgctggacgtggtgcgttcttgttgagggggtcttgatctttgtcagggtttccccaacagctgccaattttctgcatgattttcatgccgaagggtgactggttctagcaaagcaaggagcgcccagtgaaggcccaaatgcaggtgagaacttcgtggatgaacgagtgttgacagagatctgggcttcctctcggtggttctgggtcccttcaacttgttcccagcactcatctttcctcatgtggcccaagcaccttgatattttataacctgcttgacttcttccagttcctacttctagccccttgctagactccctcaccatctccctgctgcccaccacccctccgagtccacacttcttaccaggctcccaagccccacgtgttctgcggacatccccagaggcctcctcgccccccagcctgagcggcctctctaaccgcattttccttcttccccctgggcttccctgcgagccggcccactgcctggggtgcccgtcctcccttgcttgaccagtaaacgctgactcatccctcaagaccctccttgtgaaactgcctttgcaaaaaccgtaacagaaaattacgacagtgaacgagaccagacctatctgacctcatctttcttctaacctcgaaactgtccttcgtcattcctgggtgtaagctgaactctctttgggaagggatttagtgtatggtttatggaagagcccttcctagaaggctaaactgttcttttaaaacaaatgaaaggccaccagccagcaagtccagatgagagcggctggaattctaaatattcccagccattattccagaggccataggatttgcagcttccacagtgagtcttgaaggtaacttcactccaggagctgactcagcagaagagaacagtttccattccctgtgatttttttttttttttttttttgacatggagtctccctctgtcgcccaggctggagtgcagtggcacaatctcggctcactgcaacctctgcctcccgggttcaagcgattctcctgcctcatcctcctgagtagctgggactacaggcacacaccaccatgcccagctaatttttgtatttttagtagagatggggtttcaccatgttggccaggctggtcttgaactcctgacctcaggtgatctgcccgcctcggcctcccaaagtgctaggattacaggtgtgagccaccacgcctggacggtgactccctgtgatttcaccccctagccaaccagtcagcattccgattcacgggccccctacccaccaaattatccttaaaaactctgatcccaagttttccaggagacttatttgagtaataataaaactccggtctcctgcacagccggctctgagtgaatttctctttctctattgtaactgctctgtcttgataaatcagctctgtctagacagtgggcaaggtgaaccccttgggcggttacacttggagaagggttttccaaggagccttttatggtctgtcctggtaaagcaagttatccatcatttgtgcttccactggatctcatgctgatcaccgtgatttcagatccaccattttattcgtttggatgtgttcagctgcaagtaacagaccacctcactaacagtggcttaagcaatagagacatttaattatctctcagggctgggtgcagtggctcacgcctgtaatcccagcactttgggaggccgaggcaggcagatcacgtgaggtcaggagttcgagactagcccggccaacatggtgaaaccccgtctctactaaaaatacaaaaattagccaggtgtggtggtgcatgcctgtagtcccagctactcgggaggctgaggcaggagaatcgcttgaacccgggaggtggagcttgcggtgagctgagatcgtgccactgcactccagcctggcaacagagtgagactccatcttaaaaaagaataataatcctctctcggccatctggcagtggccccattagggttagttcttcaaggacctaggacctttcccttctattatccttagtgtgctgggtgtgtcttgcctcatggcaaccagatggtggctgcagcctcaagcatcacatcctcacacctcagcgtccaagaaggaagaaaggcagtgggggaaagcaccttttattcatgagtgtatctttttgtagacggaaaatccttactgtggagcacccagtagagatttccttatgtataattaattggccagtgccaagtcatgggcccaccaaccaagactaatcattgacaaggggaataggattgcatgattaatttcgaccagtcatgggtcatcccctgtgactaggtacattcaggcttctgtggtcaagaaataagagaaatgaactttgggtagatcattcggctccgttgaggtccatggaccaacaacattggcatcagctgagaatttgctagaaatgcagactctcaggccccaccttgcacccaatgaatccgaatctgcatttgaacaagatcctccaggtgattcgtacgcacccatagtctgagaagtgctatggttacccgagtcaaatcgtaagcgctagtgctttttttgttttgttttgttttgtttttttgagacggactcctgctctgtcacccaggctggagtgcagtggcgtgatcttggctcactgcaacctctgcctcctgggttcaagcgattccactgcctcagcctcccgagtagctgggactacaggcatgcaccaccacgcccggctaattttttgtgttttagtagagacggggtttcaccatgttggccaggatggtctcgaactcctgacctcatgatccacccgccttggcctcccaaagtgctgggattacaggcgtgagccaccgcacccagccaagcgctttttttcgtggagtcttactcttgtcacccaggctggagtgcagtggtccctatagggagtagggattatgtcttattgatctctatagggagctctatagggagcttagcatatatagggagtagggattatgccttattgatctctatagggagctctatagggagcttagcataataggttctccacaaagctgcttaagtaggtgagaaatgactttctgagtgtggactcctatacctgctcttggcctcttttcctacccttggtatctatccctgtacttcattgttttaatcaatatatttatttatttgtttgtttttgagatggaatttcactcttgttgcccaggctggaatgcaatggcgcaatcttggctcaacacaacctccgcctcccggttcaagtgattctcctacatcagcctcccgagtagctgggattacagacacctgccaccacacccggctaatttttgtatttttagtagagatggggtttcttcatgttggtcaggctggtctcaaactcccgacctcaggtgatccacctgcctcggcctcccaaagtgctgggattaccggtgtgagccactgcacctggcctatttattttattgtatttattttattttattttattttattttaattttgagatggggtcgcactctttcacccaggctggagtgcaagggagtgatcacagctcactgcagcctcaacctcctgggctcaagcgttcctcctacctcagcctctggagtagctgggaccacaggtgtgagcaaaccacatccagctaattatttatttttaaattctttttatttttttgtagagatggggtctcactttcttgcccaggctcatctcaaactcttgtgctcaagtgattctcccacccgggcctctcaaagtgctgggattatggcgtgagccaccgcacccagcctgcccctgcactttattagaggccccaattttctttctttctttcttccttttttttcagatggagtctcactctgtcgcccaggctggagtgcagtggcacgatcttggctcaccacaacctccgcctcctgggttcacgcgattctcctgcctcagcctcctgagtagctggaactacaggcgcacgccaccatgctgggctaatttttgtatttttactagagtcggggtttcactatgttggccaggctggtcttgaactcccgaccttgtgatccgcccacctcagcctcccaaagtgctgggattacaggcatgagtcaccgcgcctagactagatgctccaattttcacttcttgacctgaccaggcacctttaaatgtccacactcaagacctgactctctcaagtgcctgaagtcaaagacatcttttgtccttaaaaaacaaaattcctcccatagtctgcagttgtgaaaggtcctggcggtctggacatgtactcgctgttgatagtcctgttgtatgtgtagcttttgctggaaggtcctggcggtctggacacgtactcgctgttgacagtcctgttgtatgtgtagcttttgttgtgagctgcctcaaatgcttttttggaagtaggtgtggtataaataataaataaatgagtgaatatctggaagtgtggctgtttttatttaatcatgggagaatgtggttacctctgcgataagtccctctggctaagagtaaacaggatggcccggcccctgtctagaatctaaaagctgcaggctgatacagaggacgggcgtggtaggagctggtttgagactcgaccttcctttttggtgcagcttgctggttgtgtagtaggtgagtttcagagaggaaaaggtctgaagcctcatcactgccatcagagcaactgtctgtgtgatgaaaggatccctctgcctgggccttattttccgcaagcgaataacaaggaatttgggttagattgcctcaaaaggccctttgaacttggctgatgtgtgtgttttgagggagaggatctgtgaggtgcttcccagagtgagggtggggctgaccgtgcagggcaggggggacaggaaatagcaccctgaccgctttccttctcaaccacctgaggccgtggccgtctcacaggagctgggaaggagctgataagagggcttactggccccctgccataaaaggatgcagttcccactcttgaagctgttctgtcccgggcaggaggctcagcaacagagagcccctgacacccctgctctgtgcttttggcttgggggactgtcccctctgtgctccaagtggattcagtggccagcctcttccccacccagcctcaaccagcacagagcagccaggacagggcaggcagagggaggaaaagtttgcaaaagtggggtgcttggggcacagacaaccctcaggtgcctgggggatctgagggggctcctaagtgatgagaaagcagcaggggaggccccccccagtgccctggtcgaggagaagaggggctcacatttgctgtgctgcccaggctgtagtgcagtggtatgaccacggctcactgcagcctccatctcccagactcaagtgatcctccagccacaacctcctgagtagctgggactacaggcatgtgccaagatgcctggttaattttttattttaagtggagatggggtcttgctctcttgcccaggctggtctcaaactcctgggctcaagcgattccccaacctcagcttcccaaagtgctgggattgccggcatgagcaccacatccaccgcatcgctggctttgaagatgaagaagggagcgacaagccaaggaatacaggtgattgactgcctgtcattagcgcggtggctcacgcctgccattgcctgttgtccccgtcctctgtggccctcttggcttctgtatcactgtcacgcgtagcagggccaggcttgctgaactgaaccgaagcaagaagacaagggaagggctgtgggaagcgtccatcatgaggctccgtgtcctcctcccaggcctcgcctggcctcgcctcaattcacctcgggcagcagctcaacatgtgggatttcaagactaagcctgaagatcagccagaagcaagctcctcacccctgacctggccgttcccttccccgaggctttgtggccacagtcctagaagacggagacatgctttggactagcctccaggagtcagggcccttcaacaccatttttttttttttttgagagaggatctcactatattgcccaggctggccttgaactcctgcgctcaagagatcctcccacacagcctctcgaatagttggggcaacaggtgcccacgaccacaccagctccgtcgctcttcttgaatgtacctggaatcctggtctgaactgagcggttggctgaactttcctctctttttgcctctctccaggctgagagatgagccctgctaaggagcagattgctcagttatagaatatttacagtcttgtattgtagagaacagttcacaaagccccttctgcttatttcatttagttgctgccagtcagcaagatggatgccataatcatcatctccatgtcacagctgagaaaaccaaggctccgagagatctgagaaaaccaaggctcctggctgggcgtggtggctcacacctgtaatcccagcactttgggaggccgaggcgggtggatcaggaggtcagatcgagaccatcctggctaacatggtggaaccctgtctctactaaaaatacaaaaaattagctgggcatggtggttggcgcctgtagtcccagctacttgggaggttgaggcaggagaatggcgtgaacctgggaggtggagctggcggtgagctgagatcgcgccactgcattccagcctgggcgacagagcaagactccatctcaaaaaaaagaaaaaaagaaaaaaaagaaaaccaaggctctgagagatctcagaaaaccaaggctcagaaagatctgagaaaaccaaggctctgagagatctattttctgttgttgctgtaacaactgaacacaaatcgagcatcttaaaaccacacaaatggggtgggcacagtggctcatgcctgtaatcccagcactttgggaggccgaggctggtggatcacttgaggtcaggagttcaagaccaacctggccaacctggaaaaaccccatctctactaaaaatacaaaaattagccaggcgtggtggtgcacgcctgtagtgcagttactctggaggctgaggcaggagaatcgcttgaacccgggaggcagaggttgcagtgagctgagatcacgccattgcactccagcctgggtgacaagagcaaaactccatctcaaacaaaacaaaacaaaaaaccccacaaatgtattaggtcacagttctgtgggtgagaggtccaggcacagcacggctcactgctttacaagaccaaaatcaaggtataggccaggctgcctgcctttctggaggttctgggcatgaatccgcttccagtcctgtgagggctactggcagaattcagttgcgtgtggtgtgggacgaagggcttgtttcctgctggctgccacctgggggcctttctcagcttctagaggccacctgcagcccttggcttgtggctctgttccttcctctccaaagccagcgatggtggctgctgctcatgcttccaagctgtctggcatcctttgtgtcttacgtctcttctgcctttatccagagcgagttttccacttttgagggctcccgtgattagaccgggtccactgggataaccaaggataaaacctcactcacatttgcaaagtccactttgctgtgtggtataacacagtcacaagttctgggaattagggcacggacatccctggggaccatgattccgcctaccacagagtggcttccaaacctgtcgctaagctcgtaagtggcagaggtggaagctgaagatcctctggctgctgaactctttccaccacatccctgctgctttgggccatcatttacgtcaacccagctgagcccaggaagaagaccgtctcgagagagtatttctgcaggccctcggtcacccggactggctcctcaccccctgcgactgtcccagaagttctctggaagtcaaaactaattgatacaagatggggctgaggcaagtcgagggcctctgcctgtttctgttgtagaagcctccaggaaggcctcacatcgccggtagatgtcctgggtaccgcggagtgcacttcctttcccgtccagatcgggcagggtgaaagaatgagctggagattccgaaataaaccagcatccctgactgcggcagacacggcccctccaacgtctgcctctggtccgcagtaaaagtatatttattccttcccatcaggaacttccccctataagcagattggatgctacatacctttcactcattcacgattcattcactcatgatcgtacccctgctttgtgtggggcacattctagacactccagatctatcagtgaacagaagagacaggcctcatggagcctgcattctggttgtggcaaggagagggttgacagttataaataaacacagtatatgagttaatgatgtcatatgttagaataagagctattaaaaaaaagagagggtgacaggatacggggatcaggagtgctggtgggaatgcagacggcactgttaaacatgggggacagccgggcgtggtggctcaagcctgtagtcccagcactttgggaggccgaggcaggcggatcgcctgaggtcaggagttcgagaccagcctggccaacatggtgaaaccccatctctactaaaaatacaaaaaattagctgggtgtggtggtgggcacctgtaatcccagctactcaggaggctgaggcaggagaattgcttgaacccgggaggtggaggttacagtgagccaatatcacaccattgcactccagcctgggtgacaaaagcgagactctgtctcaaaaaatatatatacatatatgggggataaggtgtgtttcactgagaagatgaggtttgaacaaaaacttgaaggagagatgtagcgaaatggatacttgaggtgggagcattccacgtagagggggcagccatgcaaagtccctgaggcagaagcatgcttgacatattggaggaacagccaggagcccagtggattggagagcacagccactataaggacttggtttgagtggaacaggaaacccgggtggggctttggataaagcaacgacttgtcaaaagttcttgagtttccacggaatgctcacgcagggggcaggtggagcatcctggtcctgcggattctgctgataaaccggaggcaagacggatggctggctgggccaggtggaggctttctggaatgtagccttgggagaattgtggatgctgaggcaggtgggccctggcctcgggtcagctcatagatgagggagcggttgctgggccgtgcagattggcttgatatcgtaaaccaactggatgaggacagagattgatgctctccagggtctcacaagctgagccacagaaacaccccggcatccaagccaggagatgggaacgaccggctcccacatcagagaatcagcaacaagtcaagctttgtgagggggaatccaggtgaaaccgtgtaggtttcaccataagttaccagctacgaagccaagcaaaatcatgattgtcccggtggagctttaagtgagggagaccctgaggggtttgtgtcgattactttggacattaacaggccctgctggatggaagtggcacagggccagctatgtccagtgtaagatgtggtggaggcgttgccattccctttgtcccaggtgctgtcttgattatgttgatccacaaaaaccatgattacaggggctttcagagtttctttttttttcttttgtagagacgggctcttgccatgttgcctaggctggtctccaactcttgggctcaagagatcctcccaccttggcctctcaaagtgctgggattccaggcgcgagccaccatgcccagctccgagttccaaccccagctttctgtcttgcccctccaagcgcccttccccatgggaaactctttttgtgctccgcggataagaagctcttcttccttgagggtttcaggacagaggacactggggagaagatacctgtgtctctactgggcagctgctccagtcagtggtgtctggtggggccaaagccctgcctggagagcagagagctggacccaacagatgaacctcctgggaagctgcattcttgatggtaaatgaagagatcagaacctcacagggaggaaacaggcaatgccaatgacacctacatctatggcttgaagtgcagagagaaaagcacagaagaaaatatactaaaacatgagcaagttatatttccagggtgggggtttattggtaatattttttccttccttataattcatatgtattccaagtatatatttttcctatatctcaagtgctctgtaatgagaggaaaacaatgaaattattatatttataattatagtggcagaaaacgtaacttggtgtaaagaagaactccctgaatgaatggggactgacaaaaaaggggtcaccggccgggcacagtggctcacacctgtgatcccagccctttgggaggctgagatgagaggatcgcttgaggtcaggagttggagaccagctgggataacacagtagactctctctctctctcttttttttttttatggagtctctctttattacccaggcttgagggcagcggcacaatctcggcccactgcaacctccatctaccaggatcaagtgattctcctgcttcagcctcccgagtagctgggattacaggtgcacatcaccacatctggctgatttttgtatttttagtagagatggggtttcaccatgtcggccaggatggtcttgaacttttgacctcaagtgatctgcctgcctcggcctcccaaagtgctgggattacaggcgtgagcccccgtgcccggcccagaccatgtctctctaatttttttttaaatgagtcttcagtgaggaggctctgccacctctccgtccttgagagggacacacactgcagtgcctgggaggactggcacatgcttagaggcctgggggagagtggttcatctctctttaaaattattttactgtattttatttttttagagacaaggtctcactgtgttgccaaggttggtctcgaactcctgggctcaagggatccacccacctcagcctctcagagtgctgggattacgggcatgagccacagtgcctggcccatttttatctatttatttatttatttttattatttatttatttatttattgagacagacttttgctcttgtcgcccaggctggagtgcaatggcgccgacctcagctcactgcaacctccacctcctgggttcatggattctcctgcctcagcctccggagtagttgggattacaggcgtgcgcccccacgcccagctaatttttatatttttagtagaggcagggttttaccatattggtcaggctggtctcaaactcctgacctcaggagatccacctgcctcggcctcccaaagtgctgggattacaggcatgagccactgtgcccggccattttttaatgtttttatagagtcagggtctcactatgttgcccaagctggtctcaaacttctgggctcaagcgatcctcctgccttggcctcccgaagtgttgggattagaggcgtgagccaccgcccccagccaagtatgtctataactggggaagcctaaaccatgagccactgactgtctgttcccggcaaagtccagacgctgaagctgtgaaaagtcggctggaatgagctcggaggcccctccagcatggatcctctcgttccgggttccctgtggggtcagggctacggccaagatctctcactccagatcctctgactgtgtcccagtgccctggtcactgctcttctgggtttgaagggtcttgagtgttttcatggcctcttgtcaatagaagtatattttctgccctttcccagactgtcccaggagagacttctctgccctcttctccttctgaaacagtcctgtgcgtccctactctgctcagcttcatcccaataactcaggaagcaggaaacactcaggaagggcttactcagcactaagccctgggaaatagaggcgagcaagacaaggtccccatccttatggaacttactcgtaacgaagagaatttcaaacggtgaaaaatgtatgcgaagcaccggggagataggacagtgagtggctgtgcagagatactctaaatacatggcccagctcatcctctctgagcaggtgacattggaatcaagaatttcatttgctgagcacggtggcccacacctgtaatcccagcactttgggaggctgaggtgggaggatcacttgagcccaggagttccagacgagcctgggcaacatggagaaaccttgtctgtacaaaagatacaaaaattaggccgggcacagtggctcatgcctgtaatcccagcactttgtgaggccaaggtgggtgaatcacctgaactcaggagtttgagaccagcctggccaacatggtgaaaccccgtctctactaaaaatacaaacattagtcgggtgtggtggtgggtgcctgtaatcccagctactcgggaggctgaggcgggaaaatcgcttgaatccaggagtcggaggttgcagtgagccgagatcgtgccactgcactccagcctgggcaaagagtgagaccccatctaaaaaaaaaaaaaaattagccgggcgtggtagtgtgcacctgtactcccagctactcctgaggctgaggtgggaggaccccctgagcccaggaggttgaggctgcagtgagctgtgatcacaccactgcactccaacctgggtaacagtgagactgtctcaaataaaaagaaaggatatttcatgatacttctctgttgatgtgtgtccctccctttgtctgatggggtctgtgtcttagtacacatatctcagaggtcgcatagtgcctggtacatagacagagcttgcagatgtgaattgaatgcatggatggacagtgagaccgtggaggggatggtccaaccatcctctgcactgttcagacccatgaggagctctgagtccaggtccagggaggcagattcctccccagaacccctcgacttatcaccgaagagtgcataggagactggagaggttgaagagcttgccccactgcacagccagctgggcggcatagctccctggtgagctcagcacagcagtgggaaacagaggtgaagggcagagccttgaacttggctgtgttctctacccactgtgtgacctcaggcaactcacccagctctccagctttgagagttgggtaacttgcccgactctcattgggcacctacctcattgagttctgtaaggattaaatcgagataaaatatgtaaagaactcagcaggcaggtgggctgagaaaaagggagcagccagcatgtctgtttctgcagtgcctcaggcaccagggcctgccagtggccacagaaatggagttgacctcaccggctcccttccagtctcccaggctgtggggcagtgacaaccccaagcaggaggctggaggcacagacttccaagaaggaggagacgaggcatgctggtacattttccaccttactccaacccttcacccacatcctgacttcttcaaaagaattattgtataaacaatataaaggcattaaaaaaaactgcaaaggaaaaacgaaccacctatgatctcagcattcgagcccaacaaggttgttttcttcctgtctagttcttccagcttgtccaggcatgtacatattttatttcgctgtagtcagagtcattatttattttttgcttgtgtaatatttttatcataaatgttcattcacaatcctgtagtcttcataagtagaattttttttttcccccttcaggacagagtgttgctctcgtcgcccaggctggagggcaatggcgcaatctcggctcactgccacctccgcctcccgggttcaagggattctcctgcctcagcctcccagtagctggaactacaggcgtgcaccaccccatgcccatctaatttttgtatttttagtacagacagggtttcgccatattggccaggctggtctcagactcctggcctcaggtgatccacctgcctcggctttccaaagtgctggatgacaggcgtgagccactgcgcctggcccataagtagaatttttaatggcaacctgatatgccaccaagctgatgcgccatcagttatttcttcattattctcttgctggatattttcttctttttgctgttgaaggacaacatatttatacataattttaatttatttacttacttatttttgagacggagtctcagtgtattgcccaggctgatgtgcagtggagtgatctcggctcactgcaacctccacctcctgggttcaagcgattctcatgcttcagcctcctgagtagctgggaccacaggcatgtgccttcacacccagctaatttttgtatttttaccagataaacggtttcaccatgttggtcaggctggtctcgaactcctggcctcaagcgatccacctgtgttggcctcccaaagtgctgggattataggcgtgagccaccgcacccggccccaaattctttatggctacattgctccccagagtggaataatttacacttttctagcagcatgtgagtaccttccaaccaactcggcacgggcttttgtgctgttgatatggttgcatcttgtcagtttcatctggtacagtgtggtgttattcactgttgaacttcctctcgaataaaatttagttcatattttttgctcattatcagtttttgtttttgtttgagacagggtctggttctgttgccaggatggagtgctacggtgcgatctcagctcaccgcagccttgatctctcaggctcaagtaatcctcctaccttagccttctgggtaactaggactacaggcatgtgtcaccaggcctaggtaatttaaaaaaaaaatgtggccaggcatggtggctcacgcctgtaatcccagcactttgggaggctgaggcgggcagatcataaggtcaggagatcgagaccatcctggccaacatggtgaaaacctgtttctactaaaaatacaaaaattagctgagcatggtggcacatgcctgtagtcccagctacttgggaggctgaggcaggagaattgcttgaacccgggaggcagaggttgtagtgagccaagatcacaccactgcactccagcctgggcaacaagagcaaaactccgtccccaaaaaaaaaaaaaaatgtttagtagagacgaggtctcattatgttgcccagtctggcctcaaactcctgagctcaagttgatcctcccacttcagcctcccaaagtgctgggattacaggtctgagctaccatacctggcctagcttatcagtcttattagctatttatgaaccttgtcttttgtcattatttgctgcaagctcttcctccaaatctttttctttttcaaaattatatttttaaaaagttataaaagcaatacatgtttatggtagaaaatctgaaaaatagagaaaaagtcataaaatatatgccaccacttaaaattaacctttattatcctgtttgtctgtctgtttttgagacagggtctggcaccgtcccccaagctggagtgttgtgagtgtggttcccagcagccttgagctcctgggctcaacgatcctctggcatgagccgctgtgcctggtgttattatcctgtttcaaaaccagctgtgaaaagataatttgaccctattgggaaatgaagatatggactggttgttggatgatactgaggaatttttgttagttttgttgagggcgtaatagcagggtagatgtatgttttcaaaatcccttatcagtttacatgctcactggaatatttacaggaaaattcatgtgacgtcttggctttgcttttaaaaactccagcacacacacaaaaataaataaatgattggggaaaattagataaaaccaaattggcagtatttgttgatactagatgatggatatatgagtattcatttcattgttctctctacttttacgtacatttgaagttttctgtgacttacgtttaaaagttatcttctcaggaggactcccaggcttagcttgcctaaaattccaatcccatctccttggctgactttcatactcctcactcctgctttgtttttcctccttagcatttcatcacgacctgccacgctaaacgcgttcttaggtatctggtcatcttggcttcttacctctccccaactggaatgtgaactccctcaggaaggaattttactgttttcttcccgcccttgctatcaacagtgcctgagtattcaaatcattatcacatgaaaaacaaactcactgttaacatttttcttcggttttttgtttttttctgagacaggctctcactctgtcacccaggctggagtacaatggcatgatctcggctcactgcagcctcaacctcacaggctcaagagatcctcccacctcagcctcctgaatagctgggattgtaagcacgcatcgcaatattcggctaattgttattttctgtaaagacagggtgtcactctgttgcccaggcaggagtgcagtggtgccatcacgactcactgcagcctcaacctccgaggctcaagcgatcctcccaccccagcctcccacctcagactgtagtcatgagccaccatgcccagccaataaaaactttaaaagacctttctaaaccatcaaggttggaggcattaaggatttttgttgttgttactgctcatttcttttttcttttttctttttttttgagacagagtctcaccctgccccccaggctggaatacagtagagcgatctcagctcactgcaacctctgcctcctgggttcaagtgattctcccgcctcagcctcccaagtagctgggattacaggtgcccaccaccatccccggctaatttttgtatttttagtagagacggggtttcaccatgtttgccaggctggtctcgaactcctgacgtcaagtgatccacctacctcggcctcccaaagtgctgggtttacagtcctgagccacggcgcccgaccatcatttcttaacgagcatacattaaaatttccaggcagtcaaacttagtgactgctttacaaacatgaaatatcacaccaatatttaaagaaatgagcaaaacctgtttttaaaaatttacacacaccaaaaacgacatggaaaacctaggcccacttttaggatcgccctctagacaaaacaaataaggaaaggctaatctttgaggaaaatatcctataaaatatacctgaggggagaaagcccctatcatgaagaaatggttagagctattctgtttcccttgtggtacttttatcactctttaagagaatccatcacaggccttcaatctctagccagcctagacacagatgtgcgtgggccgacccagcaaggggcaggaggaaaacccctctgcttcctgtccccggcttctcccacttactcccccgccccccacctctgcccgtctaatggttccctgggccgactcggtcgccctgccagcctgtcctccttcactcaggcacacactgtttccacgcccgggagcctggctcacttgcagagctataaaaacagacatccaccaggcacggtggctcacgcctataatcccagcactttgggaggccaagatgggtggatcacctgaggttaggggttcgagaccagcctggccaacatggtgaaaccccatttctactaaaaatacaaaaaactagcctggcatcatgtcatgcgtctgtaatcccagctacttgggagactgaggcaggggaatcgcttgaacccgggaggcagaggttgcagtgaaccgagatcacaccactgcactccagcctgggcaacaagagcaaaactccatctcaaaaaaaaaaaaacaaaacaaaaacactcagacatcaggctggccgccgtggctcatgcctacaatcccagcactttgggaggccgaggcagggaggatcccttaagcccaggagttcaagatcagcctgggcaacacggcgaggccccgtctctactaaaaatacaacaaaattagctaggtgcagtggtgcttgtggtggtctcagctacttgggaggctgaggtgggaggatcacttgagcccagaaggcagacagaggttgcagcactgcactccagcctcggtgacagagtgtgactccaagtcacaggaaaacccaacaaaacacagacgccgcccccacctgctttgcccgactctgcagagtcccacccggatgatctgggggagggaaggagtttgtctttttcgaagccctctgtggttttcggatgagcggatttagggacagtctgcacatgtctttcactcctgctatggaccccagaacccaccacagtgcctggctaaattgcacgtgcttaaataaatatggaacaaatgaaccaactgacctcttttgatgttcccagccattctgtgaggcagaggatcaaatgggtattattgtccccatttgacagaggcccagagaggtgacaggaattccccaaggtcacagatggaggggcccgaggctgcctcccactaccaggctgatttccagaggcttaaggtgggggctgagtttaaggaggggaaaaagaaaaacacatccccttacctagtgggtagagaggagtaggggcaagggagagaaaagaggaaacgaaagaagaggggaaagaggaaagaagaaggggaaggttagagatgcctaaaagcatggaactggaggaaagacatcaaaataacaaagagcaagactagccgcgtggtggctcacgcccgtaatcccagcactttgggaggccaaggtgggcagatcatttaaggtcatgagttcaagaccagcctagccaacatggtgaaaccctgtttctactaacaatacaaaaaaattagctgggcgtggtggtacatgcctgttatcccagctactcgggagagtgaggcaggagattcacttgaccctgggaggcagagtttgcagtgagccgagatcatgccactgtactccagcctgggtgacagagtgagagtccttcgaaagagagagagagagaaagagagagagagaggaaagaaggaaggaaggaaagaaaagagagagagagagggagggagggaagggagggaaatgagggaagctaagagggggttgggctgcaaatcctatctctgggcagcgggtctgggcccctcgtccctgcagcaggtctgggcccctcgtccctgcagcgggtctgggcccctcgtccctgcagcgggtctgggcccctcgtccctgcagcaggtctgggccactcttccctgagtttgatgcttggtttggagtcagggctctgagcccagagtccctgtggaaaacacatccctccactgactatggcctctgtcccacaacctcccccctccccaggcctgtgtgtgtttagacagcttgccctgcatttttagaacaatttttaacttgtaggctgtacctgcggaaccagaatgtctggccaagacctgttacctaacagcctcagaccatttgggtgccaacagcaactgcagctctggcccaagccaggtgtgggctgacctagccagggagcggggaagtgaaaggaatgggtcccttcccactcagagggcggagcccccacttctggtgagagaaagctgagcagaatggatctaatctgattcctccacccagaagcccttaaaatgcagctttgttttaagccttcttgaagatttgggctagatctagaaaagaacctcaccacggaggatgtgcaaagtacaacacgtgaccccggagacggaagctcttctctacctccgtaaagatgatctctgatgaacagacatgatcatgcctggagaacagggatggacagtcccgcttctgaaagaccctgtctggctgatgattcatggtgcgccgggcagaccccaggccaagagaccccacccacagtacctgagtgctcagctgggaaccagaccagacctcaaaacaggtttgcagaattaagatgaggagctgagctcaacacagcctccgcagctccccagggcgggcctgagccgagggagagcccatggccatcagggtgctggaatgcatgtcacactgcattacgtgcattacgatccacgctgcaatgacagcccagagcgtggagaacccagagagggtggggagatggaatcccggcgagccagcgctggcagggaccacggggagcagctggtccagccgccggttttccaagagagaagactaagaagtgagtcacttgcccacagccacagagagaaggagggcaacgaggccggcaggtcagcagcgagcagttagttcaaggccttgagggcttccactaactttgaagggcgaggatgggcggagctctggaggccgccggggtaggttcgaggggagtgttcaagaagcctcttttttttttttttttttttttttttttttttttttgagacggagtcttgctctgtcacccaggctggagtgctgtggcgtgatatcggctcactgcaacccccacctcccaggttcaagaaattctcttgcatcagcctccggagtagctgggattacagacacccgccaccacacccggctaattgttgtatttttagtagagacggggtttcaccatgttggataggctggtctcaaactcttgacctcaggtgatccacccgccttggcctcccaaagtgttgggattacaggcctgagccaccacaacaagccaagaagccctttttgtagagttctaatcctgggtctgcggctgagccatggttgtgttcacaaagcagagcaatcaaccgggcatagggatggacctcctggggccaaaatggcggctgacatctccaccctgacctttcttctcaggttcccaaggttaccacccaaccctgccaactttcgcaccccgcaaggagcaagaccccgcccgctcaccacctgcctgtgcagccaacgggcctcgctgagctgccctgggccgctccctccattcacacagttggccctccctctccctgcctcccttcgcctaccccacgaactacttcatccctctgggccggcactgtagaagccccattgttcacatcgacctcccaattatctcctctttccctctccctctgctcctgcccagaccagccccccagcattgacctggatgcctgccacagcctcctccctggtctccggcctcccacctctgctcctcggtctcctctacccagccagtaactgcagagagcactaaagcacagtcctggcatctcacccccttaaccctggccacggcttcccagtgcctccaagataaagcaccaacacctgaggacagcaggtgagtcctcccggagctagctctcccccaccttcctgtcaccctctgccccaggctctgcccgtgctgctgccccctgaacccacacttccgtcttttgctttccctttccctgggatgctcttataccccctggccccctgggatatcttctcatctgttaagtctcaacccagagctgcttcctctgggaaaccctcattggtctcctcgggcagaggctggtgtttttctctcatgcgtcctcgggcagaggctggtgtttttctctcatgcgtcctcgggcagaggctggtgtttttctctcatatgcctgcaacagcctgggatttcctctctcagcgctttttttttttttaatcaaaaaaatttcgacggggagacaggatctcactatgttacccaggctggttgtgaactcctagcctcaggtgatcctcctgcctcggcctcccaaagtgctgggacgacaggcatgagccaccgtgtctggccctctcagcactcgctaccgagggtgttctaatacttcattcgcctgctgtgggaggcagcctctaagatgacgctcagtgatccctgcctcttggtatttcctgtgtaaaaccgtccccttgaatgtgggctgggctaattgactcactttttaatttatttttcagagacagttttaaatttatttttcattctattgcccaggctggagcacagtggcataatcatagctcactgcagcctcaaactcccgggctcaagtgattgcccaccttagcctccctagtagccaggaatccaggcgcacaccaccacgcctggctctgattgacagacgcacaccaccacacctggctctgattgacaggcacacaccaccacacctggctctgattgacaggcacacaccaccacacctggctctgattgacaggcgcacaccaccacgcctggctctgattgacaggcacacaccaccacagctggctctgattgacaggcacacaccaccacgcctggctctgactgacaggcgcacaccaccacgcctggctctgactgacaggcgcacaccaccacgcctggctctgactgacaggcgcacaccaccacgcctggctctgactgacaggcgcacaccaccacgcctggctctgattgacaggcacacaccaccacagctggctctgattgacaggcacacaccaccacgcctggctctgactgacaggcgcacaccaccacgcctggctctgattgattcacttcaaaccaggagaatctgtaactgcccatgtgctcttcttgcccaatgcccagttagagctgatttattacaacaggggaattgcaatagagaaagagtttaatacacgtagagccagcgaaatgggagaccagagttttattattactcaaatcagcctgccccaaaattcagaggcgaaggtctcttaaggagagtttggtgggcagggagctatgggacgtgtgctgctgatcagctgggggggcaatcacgggggtgtggaaattggcccttgtgctctgaggcagcctctgggtagtggccacagaggagctgctggtttgggtggggccttccggtcatcagtaacctgaaaccctgaaaagagatctcaaaaggccaatcttaggtcttacagtagtgatgttatttacaggagtcattggggaagttgcaaatcttgtgacttctcatgggaatcatctcacagcacccacatattcgcggaattcatgcccctttcctcctcttaacccagtggcctttggaatagtggctgggaatcatctcacggcacccacatcttcgtggaattcatgcccctgtcatccccctaacccggtggcctttcattagttttacaaaggcaatttagttttggaaagggctattatcatttaaactataaactacatttctcccaaacttagcttggcccacacctgtggatgaccaagggcaccagcctgaacaacacggtgaagcccctcatctactaataatacaaaaattacccgggcgctgtggcgtgcccctgtagtcccagctactcagggggctgaggcaggagaatggcatgaacccgggaggcggagctggcagtgagccgagatcacaccaccgcactccagcctgggcgacagagccagactccgtctcaaaaaaaaaaaacaaaaaacaagcagtgaatgtggatctaaacaaaatcacaacgtaactcaatcaggaggaagagaagggcagagagtttctgtgtggtggggacagggagaacaaaaatgagctacatcctcattgttcacagtgaaaactcaatagatttatctcaggctgggcacagtggctcacacctgtaatcccagcacttcgggaggttgaggccggctgaccactggagtccaggagttcgagaccagcctgggcaacataggaagaccccgtctctacaaataattttaaaaattagccaggtgtggtggtgcatgcccgcggtcccagctactcagaaggctgaggtaggaggatacctgagcccctggaggtcgaggctgcagtgagctaagatcacaccactgcactccagcctgggcgacagagagagacctgtctgaaaaaaaaaaaaaagaatcatctgaaaaaattgacagtggttgaaaatcattgacatgaggccaactaattaacagaaaaaaggcataaaactaatttacatgcacatagggagagtcagggtgcctgcgccccagtggggttcagaagctcatacagcatcctggcagcacagtttatgggaggcaggaaaagagggggataaaggattactagggaaagtaaatggatctaggaacagagatcagtttacatactattttgtggaaagttctgttcaagtttggttacattcctggctttacaaataattgctccttgtgggtctggaacttgaccaattaaaaaacttcaacttctttggggaaaggtcagagagacctcaaggcttcttcggtcccatatgtcaaagcaccatattctggggtattggtttctgagttccagcacctgtaaggagtagaaaaaggagtctgagttgcaaaggatgggggttttcacaccaagtaaactcataaaactatgttcaagtataactctattacaaattaaaatacaaatctaccacggctgggcacagtggctcacgcctgtaatcccaacacttcgggaggctgaggcgggcagatcacctgaggtcaggagtttgagaccagcctgaccaacatggagaaaccccgtctctactaaagatagaaaaattagccaggcacggtggtgtgcacctgtaatcccagctactcgggaggctgaggcagaggaattgctcgaacccaggaggtggaggttgaagtgagccgagatcgcaccactgcactccagcctgggtgacagagcgagactctgtctcaaaaaaaaaaaaaaatctaccacaatgtctacatatggaaggtgctccaaaagcgtgaaccattagaattcctatggaatgacgttttcatcaaacagcttttgctatacttacaggtggatgtgattgcaaacaacaaagcctgaactcagatggggaaagaatcagtggggatcatattgtgtcatgtccaagaggttcacagatcaaattcaggcatggctggatccaggcgttcacagcgtgccaacagagatcttgctgtctccatttcttggctccattcactgtgttgactttgctctcaaacaggctcctctcagaccttagcacactggcctccagcggttgcaggattctatactgctggcttagtgctcccaacagaaaaagagtgtctctacttggtagttgcaaccaaatgcctcagatagacactgacatggtttggctctgggtccccacccaaatctccagttgagtcctaatcctcagtgttggaggtggggcctggtgggaggtggttggatcatggggtggatttctcatgaatggtttggcaccatcctctcggtgctgttctccatagtgagttctcgagagatctggccgtttgaaagtgtgtggccccaccccctcgctctctctcttgcttctgctcctgccgtgtgaagtgcctgctcccgcttcgccttctgccatgattggaagtttcctgaggcctccccaaaagccgggaagaggccagcgtcatgcttcctatgcagcctgcagaactgtgagccaattaaacttcttcttttttttttttttgaaacggagtttcaaaaaaacaacggagctcttgttgcccaggctggagtgcaatagtgcaatggttgggattacaggcatgcaccaacacgcctggctaatttttgaatttttagtagagtacagacgaggtttcaccatgttggtcaggctggtctcgaactcccaacctcaggtgatctgcctgccccagcctcccaaagtgttgggattacaggcgtgagccaccacatctggccaattaaaatgatttcttcttttctttataaattacaccgtctcagggttttttttgttttgttttttgttttttgtttttagacggagtctcactctgtctcccaggctggagtgcagtgatgtgatctcagctcactgcaacctccgcctcctggattcaagcgattctcctgcctcggcctcccaagtagctgggaccacagtcacacaccaccacgcctggctaattctgtatttttaatagagacagggtctcaccatgttggccaggatggtctcgaactcctgacctcaggtgatccgcctgcctcagcctcccaaagtgctgggattacaggcgtgagccaccgcactcagccagtctcaggtatctttttacaccagtgtgagaacagactaatacagacactcattgatctggcttgggtcacatacccacccttgaacagattgccgtgaccaagggaatagagcacttggattggctaaatcccagtcctaagccgaccgctggaaccacggacaaagtgggggcagagtggtctcacaaagaaaaatatggatgcttttattagaaagagagaagacgctgcaaaaccaacaggtctcccctgtgtctgaagactgagactaggccaggcacgatgactcacacctgtaatcccagcacttcggggggcggaggcaggcgaatcacttgaggtcaggagttcaagaccagcctggccaacatggcgaaaccccatctatactaaaaatacacaaattagacagatgtgcttgtttgaacccagggagtgaaggttgcagttagctgagagtgcgccactgcactctagcctgggcaacagagtaagactctgtctcaaaaaaaaaaaaaaaaaaaaagactgagactgctgtttgccttcatcagcacagaagccgctagttaggaaccattctcctagcacacccactccctgtgcttcacaaaagcaggtcaatgtttacagaagtcccctcttcccacgtcttctcatcttcaggggaaactgttgcgaggaacagaggactggagagaccaatacgggaaacaggaggatgtttatttaaggtgcaccagctcagaggattcgtatccaaaaagctgagcattgaacaaagtcagggtttagcttatataggccagcgcaaaggctgtcaatcacacagtgacagcttctgtcatctacagcataactagtgacttggcacaacctgtgcccttgcatagcgggtaaccttgcagctgaggcaaaagaaaacaggaacttacaaatctgactaagtacaagcattggcaaacatagtcagaattattagttcagagaaggagagacagtcaaggaatttggttttggggattttttgtttttcaaccatgctcgggggtgtctggagcctattcttgcagcttttgcttctcagactaggtcaccgcgacctttttatagccttgcctgttactatccttaaagtaaataaatgcagtacttatgtttctttaaatttctgcctcaaaacaacactaattctcctgattgtctttcatgacagtttccagacctctcacttttctggctgtctttcctggatgctgagtaatgtcaaatgtggcactaaaattcagcacccagggctgaatgaagcttcaggtgtgccccgatcagcccagaggccagtggcatgctcagctcaattctgcttggcagcaaagccacttacagatgcactggcttttcaaacgactgaatgcattgttgactcttactcagcttgcagccaatatctttttttatgtgagctgtcatcaagccagggattcctcattctccattggtgcaactggctcttgaacctacatcaagaactttgtccgtgttcatttcacattgtaggtcttagtgcatttttgctgttctttgaggtgtttttgaatatagatcctgtcttcagtactaaccatctctccgggttttgcacaatctacccatttgaatggagacattcttaattttcatccaagaggataataaaataaatcagggtcaaggttaaaactcacaaccaggcgtggtggctcatgcctgtaaccccagcacttttgggagtccaaggcgggcagatcatttgaggtcgggagtttgaaaccaggctggccaacgtggtggaacccaccccccatctctactaaaaatacaaaaattagccgggtgtgctggcatgcaccggtagtcccagctactcatgagtctgaggcaggagaatggcttgaacccaggaggtggaggttacagtgagccgagatcgcgccactgcgctccagcctgggcgacagatcaagactctgtcacaaaaaaaaaaaaaaagaaaagaaaaggataaaactctgtcccaccacccaagcccacgtgacatgtggacaataattagcatattctggatgtgaagccaaatccctatggaacaaccaaactctattcgttttccagttttgccataacacgtaatcacaaactagatggcttaaaacaacagaaattcattctctcacagttctgccatcagaagtcctaagtcagcagggccatgctccttctgaggctctagggaagagtccttcctagcctccttctagcttttcagggttgttgtgtatccttgatattctgtgggccgtagctcatccttccatccctacctctatctccacataggggtccctcctcttacaagtcattgaatatagggcccaccctaatccattatgagtttatcttatttgattacatctgcaaagacccctatttccaaacaaggtcacatgcccagggactaagggttagaacttgaacataactttttggagagcacaattcaacccacaacacaagtaggatcagtttccgtctttctgtctccttgacctccaggctctgaagagcatctccatcagaaaacttgctgcagcctcgacctcctgagttcaagtgatcctcccacctcagcctcccaagtagctgggactacaggtccaggccaccatattcagctaatttttttattttttgtagagatggggtctctgttgcccagactggtcttgaactccttgtctcaagtgatcctcctcctttggctgggattacaggtgtgagccactgtgccctgcacttgctgacatccagatggccataggattccatgtacccctggcccccaacaccagtcaacctgatccactaacccagtctagagtggtggttgtcagcgggaactctgtgtggctgccctctccctttccaactctttgagattcagacaaaatctgccctgggggaggaggctggagactcctggttgtggaggatgcaggccatggagtgacttgctgaagagaatggcgtgagacagacctcagtgactttgggcttactcagcctcccttgcaactcattttcttcagctgtaaaatgtaaataataaaacctatccagctgggcgcggtggctcacgcctgtaatcccaacactttgggaggctgaggcaggcagatcacaaggccaggagttcaagaccagcctggccaacatagtgaaactctgtctctacaaaaatacaaaaattagctgggcgtagtggtgggaacctatagtctcagctacttgggaggctaaggcaggagaattgcttaaacccaggaggtggaggttgcagtgagctgagatccgtctaaagaaaaccaaaaagcaaaaaacctatcacctttatgaggattaaatgacatcacatttgtaaagtgcttagcccaggcagccgtgagtagcagtggtcgttgccaattgttgccgctgttagctgcttgggagtcagataaagctagatttgaatcagatcttttcttttgttttttttttgagggacggggtcttgctttgttacccaggctacagtgcagtggcaccatcatagcttattgtagtctcaaactcctgggctcaagtgatcctcctgcctcagcctctcaagtagctgggactacgggcgtgtgccactggcccaccaactatgaacccagattttctttttaaaaattgttttttaatttttttttttttgagacggagtttcgcttttgttgccaggctggagtgcaatggcacatctcggctcaccgcaacctccgcctcccgggttcaaacgattctcctgcttcagcctcctgagtagctgggattacaggcaggcgccaccacacccggctaattttgtatttttagtagagacggggtttctccatgttggtcaggctggtctcaaactcccaaccgcaggtaatctgccctcctcagcctcccaaagtgctgggattataggcgtgagccactgcgctcggcccagtttttaaattttttgtatattcttctcttttttccccataggttattggggtacaggtggtatttgctcacatgagtaagttcttttgtggtgatttgtgagatttgggtgcacccatcacccgagcaatatacactgaaccctatttgtagtcttttatccctccctccccccacactcttcccccaagtccccaaagtccattgtgtcattcttttttgctgttgttattttttgtttgttttttgtttttgtttttgagagagagtctcgctctgtcacccaggctggagtgcagtggtgcaatcttggcttattgtaacctctgcctcccaggttcaagcaattctcctgcctcagccttccatgtagctgggattacaggtgcatgccaccacacccagctaatttttgtatttttagttgagacggggtttcgccatattggccgggatggtctcgaactcctgacctcaggtgatccgcctgcctcggcttcccaaagtgctgggattacaggtgtgagccaccacacccagcctagatggcttttattatattgagatgtgtcccttctatgccgattttactgagagttttaatcataaagggatgctggattttgtcaaatgctttttctgcatctattgagatgatcgtgtgatttttgtttttaattctgtttatgtggtgtatcacatttattgacttacatatgttaaaccgtccctgcatccctggtatgaaacccacttgatcatggtggattatctttttgatatgttgttggattcggttggctaacattttgtgaaggattttagcatctatgttcatcagggatattggtctgtagttttctttttaggtcagttttctttttggttttcctggctttggtattagggtgatgctggttttagagaatgatttagggagcgttccgtctttctctatcttgtggaatagtttcagtaggattggtaccaattcttctttgaatgttggatagaattctgctgtgaatccatctggtcctggacttttttttgttggtaatttttaaattaccatttcaatcttgctgcttgctgttgttctgtttggggtatctaattcttcctgatttaagctaggaggattgtatttttccaggaatttacccatctcttcttggttttctagtttatgcatgcaaaggtgttcacagtagccttgaatcatctttggcatttctgtggtatcagttgtagtatctcctgttccgtttcttagtgagattatttggattttctctcctctctgtttttctttttcttttctttttctttcttcctttctttctttctttattattattatttttttgagatagaatctcactattgttgcccaggctggagtgcaatggcacgatctcagctcactgcaacctctgcttcctgggttcaagcgattctcccacctcagcttcccaagtagctgggattacaggcgcccaccaccacgctcagctaatttttgtattttgagtagagctggggtttggccatgttggccaggctggtctcaaactcctgacctcaggcgacccacctgcctcagcctcccaaagtgctgggattacaggcgtgagccgctgcgcccggccctcttcttttcttggttaatcttgctaatggtctatcaattttatttatcttttcaaagaaacagcttttggtttcatttatcttttgtaattttttgtttgtttgtttcaatttcatttagttctgctctgatcttggttatttcctttcttctgctgggtttgggtttggtttgttcttgtttctgtagttccttgaggtgtgaccttagattgcttgtgctctttcagacatttttttttttttagacagagtctggctctgtcgcccaggctggagtgcagtggcgcgatctcagctcactgcaagctccgcctcccgggttcacgccattctcctgcctcagcctcccgagtagctgggactacagatgcccgccaccgcgcctggctaattttttgtatttttagtagagatggggtttcaccgtgttagccgggatggtctcgatctcctgacctcgtgatccgcccccctcggccttccaaagtgctgggattacaggcgggagccactgcgcccggcctcagactttttgacgtaggtgtttagagccacgaactttcctcttagcactgcctttgctgtgtcccagaagttttgacaggttgtgtcactattgttgttcagtttgaagaattttttaatttccatcttgaattaatttttgacccaatgatcatccaggagcaggttatttaatttccatgtatttgcgtggttttgaaggttccttttggagttgatttccagttttattccactgtggccatgagagagtgcttgatagaatttcaattttcttatatttattgaggctcgttttgtggcctatcatatagtctatcttggagaaagttccatgtactgttgaatagaatgtgtattctgcggttgttgggtagaatgttctgcatatatgttaagtccgtttgtttcagggtatagttttaatccattgtttctttgttgactttctgtcttgatgacctgtctagtgctgtcagtggagtattgaagttccccactattactgtgttgctgtctatctcatttcttaggtctattagtcattgctttacaaatttgggagctccagtgttaggtgcatatatgtttaggattgtggtattttcctgttggacaaggcctttcaccattatatactgtccctctttgtcttttttaagtgctgttgctttaaagtttgttttgtctgatgaaagaatagctacccctgctcacttttggtgtccatttgcctgaaatgtctttttccagccctttaccttaagcttgtgcgggtccttatgtgttagacgagcatcctgaaggcagcagatagttggctggcgaattctgacccattgtgcaactctgtgtcttttaaatgcagcatttaggccattggcattcaatgttagtattgagatgtgaggtagcattccattcatcgtgctatttgttgtctatatggctcggttttttgtttttattttttaaattgtgtttttgtttcatacgtcctgtgagatttatgctttaaagaggttctgttttgatgtgtttccacgatttgtttcaaggtttagagctccttttagcagttcttgtagtgctggctgggtagtggcaaattctctcagcatttgtctggaaaagactgtatctttccttcatatatgaagcttagtttcactggatacaaaattcttggctgataattgttttgtttgaggaggctgaagataggacctgaatcccttctagcttgcagggtttctgctgagaaatctgctgttaatctgataggttttcctttataggttacctggtgcttttgcctcacagctcttaggattatttccttcgtcttgactttagataacctgatgactatgtgcctaggcgatgatctttttgcgatgaatttcccagatgttccttgagcttcttgtatttggatgtctaggtctctagcaaggccgggcacgttttcctcgattatttcctcaaatatgttttccaaactgttagatttctcttcttcctcgggaacaccaattattcttaggtttgggtgtttagcataatcccagaatccttggagcctttgttcatattttcttgttcttttttctttgtctctgttggattgggttaattcaaagaccttgtctttaagctctgaatttctttcttctgcttgtttgagtctattgctgagactttccagagcattttgcatttctattaggtgtgtccaatgtttcctgaagttttgattgtttttcatttatgctgcctatttcctggaatatttctcccttcacttcttgtatcatttttttccttacattggggttcgcctttctctggtgcctccctagttagcttaataactcacctcctgaattctttttcaggtaaaccagggatttttttcttggtttgggtccattgctggtgagctagtgtgattttttggaggtgttaaagaaccttgttttgagttggttttctggttccttctcattttggtagtctctgtcagagggaaggtctagggctcaaggctgctgttcagattcttttgtcccacggggtgttcccttgatgtagcactctcccccttttcctatggatgtggcttcctgaggacaagctatagcgattgttatctctcttctggatttagccacccagcacgtctaccaggctccaggctggtactggggttgtctgcactgagtcctgtgatgtgaactgtctgtgtgagtctctcagccatggataccagcacagtatttggggtgtctcatgggtcctgcaggagcgatctgcttccttcatggggtctgtgggtgctctcagctttcctgctttattcctgcagtcattccagagcaaaaattcactatgtgagtctccacagctgctctgtccatctgagtcacagctgcaatctagtcctgcctcccgtccgccatgatccctgtaactctctatttattattattaattattattactgagacagagtctcgctctgttgcccaggctggagtgcagtggcacagtctcagctcactgcaactccgcctcctggattcaagggattctcctgcctcagcttcccaagtagctgggattacaggtgtgtgccaccacgcctggctaatttttctactttttgtagagacaggacattgctttgttggccaggctggtctcgaactcctgacctcaggtgatctgcccacctcaacctcccaaagtgctgggattacaggcgtgagacatggcacccggcctgaacccagattttcaactgccccctgaagcaaatttctttttttttttttcactttgctcattttattttattcaatcctcacaacaacctaagaggtgtattataatcagcactagtttaaaaatatgaaaactgaggcttagagacattaaataatatgtttaaagtccttgagctaataggcagaggagctgtgattaaaaaccaggtttgatgacataatgtctacattcttaatctgtggtgttgaatttccaaacacatttaagtaattaagtcccataatgtttcacacaccacacaactctgagaggagtttctcacaacactcactgcagcccttcagtttcggcatctgtaaaacgagacacctgactaacccttaggctgctgtgagcgctcaggtcacccagcatggagcctggagtgagaaacctgttacagatgtttgcttcttcccttcccttctcctgtgaataaaaggggctgttcacctgacatggcctacccttaggaaactcaaggtgcctcttttttttttctgagacagagtcttgctctattgcccaggctggagtgcagtggcacgatcttggctcactacaacctctgcctcccggattcaagctattctcctgcctcagcctccccagtagccgggactacaggcacacgccaccacgtctggctaatttttgtatttttagtagagacagggtttcaccatattggccaggttggtctcgaactcctgacctcatgatccgcctgccttggcctcccaaagtgctgggattacaggcatgaaccatgatgtccagccatgaccactctcttttctatgtccctggggagagacctcgaattttatttggagcctgtctttataaagactctaaattgtggccaggcacagtggctcatgcctgtaatctgagcactttaggaagccgaggcgggtggaggtcaggagttagagaccagcctggccaacacggtgaagccccatctctactaaaaatacaaaaaattagctgcgtatggtgccgcacacctgtaatccccagctacttgggaggctgaggcaggagaatcgcttgaatctgggaggtggaggttgcagtgagccaagatgacaccactgcactccagcctgggcaacagagtaagactccatctcaaaaaaaaaaaaaaaagactctaaatagtgtttatatatggtgtatatatatatatatatctttgatgtatatctttgtccatcaggtcagcttgttctttcgaaaccctctccagtcactagttttgttgtcgttgttgttgtctgagacggagtttcgcgctcgtcacccaggctggactgcaatggcatgatcttggctcactgccacctccgcctcccaggttctagcaattcttctgcctcagcctcccaagtagctgggattacaggtgcgggccaccacacccagctaattttttgtattttgagtagagacggcgtttcactggttcagtgtttgtacgtgagtgcgttcccacaaatggcagtgtgtgctgtgcgtggtttggtaaccttcattgttttactccacagcttgttttgagagtcccctccattgaaacacgcacatctaatttgtccttcagttcgctggactccacgctgaacgtgccatgctccattgccccgtgagtaactccatgctcttgccggtttcacacggcctctcagagctggagcctttgttcaggagccctgggcagctttcaggaagctcttgggctcatcagcttcctctggctgaagccgccccagtggaatcatggggatttcttactttgaaggtggggccacccgcagactgtaaccggctggttcaagatcaaggacttccccaggccacctgcctcagaggcaagaaaggctcagctgagtcccagacactcctcgctgtggcccctccttcctccctgctgggcaggcccccctcaattctgtttgccagcagggcctagtaacactgaaagacgaaaagggaaataaaataaacacaattaataggctaaaggttactgaataaagtggcagcagtaaataaattgactactgtgcaaatacaaagacatgaagacatgaaacccctgctctaaatgaccactcaccaagagcaaggcctgggctggaggcagggagcacctccctaaggagcactccctctttcccggagtgagtcctccttctagatggaattcagtccgggttcctcttgagccacagtccctgttggggcctatctcagtggactcaagatcctgaacttcttccagattgctgactacacatttgagtcacccagagattaaaagaaaaaacaaataatttcccagtgatcaggagtaaatcagctggggcagggttggtgctatgaatgaccacactgatttgtacacttcactgatttgtagtgtttgctatttccgtcgtgtaaatactgccaacatggacaatcttcagttgctaatggtttactaactggcttgtaaatgaattcattcagtattcaagaaaatggcactacatttagaaacattttgtagcatttcttactttctaagaatttccaatagacaccatgatcactaaaaaatcataaccaggctgggggcagtggctcacgcctataattccaataatttgggagaccaaggagggaagatcacttgaggccaggagtttgagaccagcctgggcaacatagcaaagactccatctctacaaaaaaaaaaaaaaaaaaaaaaaaaaaaagttaggcagctggtggcaggcacctgtggtcccagctattcaggaggctgaagcaggaggatcacttgagcccaggaggttgaagttacactgagccgtgatcacaccactgcattccaaataaaaactaaattaaaatatatatatatatatatatatatattttttttttttttttttttttttttttttttctgagacagagtctagctctgtgtccagactggagtgcagtggcatgatctcggcaacctccacctcccaggttcaagtgattctcctgcctcagcctccggagtagctgggattacaggcgtctgccaccacgcccaggtaatttttgtatttttggtagagatggggtttcaccatgttggtcaggatggtctcgatctcctgacctcgtgatccacccaccttggcctcccaaagtgctgggaatacaggcgtgagccactgcgtctggcctaaaataaacttctaaaaaagaaaaattggccaggcacagtggcttatgcctgtagtcccagcactttgggaggtcgaggcagttggatcacctgaggtcaggagttcaagaccagcctgaccaacatggtgaaaccccgtctctactaaaaatacaaaaattagccaggcatggtagtgggcacctgtaatcccagctactcaggaggctcaggcaggagaattggttgcacctgggaggtggaggctgcagtgagccaagatcataccattgcagtccagcctgggcgacagagcaagacttcgtctcaaaaaaaaaaaaaaaaagggaaagaaaaattataaccaatcgacattcaataaattatttattggctgggcgcagtggctcatgcctgtaatcccagcactttgggaagccgaggtgggcagatcacatgaggtcaggagttcgagagcatcctggctaacatgatgaaaccctgtctctactaaaaatacaaaaattaggtgggcatggtagtgcgagcctgtagtcccagctacttgggacgctgaggctggagaatcatttgaacccgggaggcagaggttgaatgagccaagaatggcatcactgctctccagccgggacaacagagcaagattctgcctcaaggaaaaaaaaattcaataagttatttatttgtcaaataatttataaagcagctttctcaaagccctttcaaaaagtttacagcagccaagagtggtgactcatgtctgtaatcccagcactttgggaggccaaagtgggcagatcacctgaggtcatgggttcgagaccagcctgaccaacatggtgaaaccacgtttctactaaaaataccagaattagccaggcatgttggcatcagcctgtagttccagttacttgggaggctgaggcaggagaatcacttggacccaggaggcggaggctgcagtgagccaagatcatgccattgcactccagcctgggcaatggagcgagactctgtctcaaaaaaaaaaaaaattacagcaaaaaatacttgatgtgggccacaggtgtgttttaatatgcttgatctgatgtgcgagaggccctgagagggagtgtttccaggacctacagagggaatgagagaggagagtccctgctgtcgggaggtgggtgagaaaagctcctaccactgcagaaatcctcctgtaaggctcctcggcggctcaccaggcgattcctcagcgaagaaaggtgaggcagcttgcccagggtcacccggccagtctcaattgaggactgacaaccaaaatgagtgactgaggcaagtcttaatcactgaggtttattaagccacgttagggcgcttctgggaaaaacaagccacagacacatctgtggctgtttttcccaagaagttccaagttttgtatttgtacatttcttcctttttttttttctttttgatacggagtttcactcttgttgcccaggctggagtgcagtggcgcgatctcagctcactgcaacctccacctcccgggttcaagcgattctcctgcctcagcctcccgagtagctgggattacaggcatgagccaccacacccgactgatttttgtattcttagtagagacggggtttctccatttggtcaggctggtctcaaactcctgacctcaagtgatccacccacctcagcctcccaaagtgctgggatgacacctaggaagaggggcaggcgggcagtcaggcttaggcgaacactacattttatataagataaggtgaacatctgaaggtggaaatgagcgccactgcactcagcctggacaacagagcaagaccctgtctcaaagaaaaagagaagtgtgagtggtcctgatttttaaaattttcctttacaggactttggacactagaactaggcctctttccaaaacatgctgatactgaaggggtcacgctgaaggctgagggctagggcctttaaaggtggggcaccctcttccttctacccgtccttgaccctcagcagactacaggttgatctcccctttgccatgagtgcccaaggagggaacttgtgatctagcagtttcttgataatccccaaaaggctttaattactccatttccctgccacgcccagggcaggaggagggtgagcgggaaagctgtccaccttctgctaaacgggtcaggaggcatcgggagccacgtgggttgtggtttaggagcctgagctgctgatccccaggcaggcctacacaatgggagctgctccctgcagcccccgggccggcctgggttgcataacccatgaggtcagcccggcctgcggcagttgctttcccacaacggaggggccgctccccacctcctgcgggacccacagccctgggtctctttccagctttcctctttcactggcaaagctgcaggccccataaactggggaagggttgaggccctgcctctcctgaactgggcaagggtcgaggacttccccatgggtccaggcctccagcattacatcaggaggtagcctggggaggacagagcactgaatccctctggcatcagctcctctggccagccctgcacctgctctgtggggctagggcctggggaggtgtcccaaaatagcccgcaggggcccgggagctctggccttcaaggtcagacactagcactgagaatcctggtgaggctgtcttcccagaccccgcctggcaggccggctgggcacggctgcggagaaagacagggcaggctccccaggcactggcccccgcggcaacctctcctgtctctaaaatcggatgtagattaagaacgctccatctggcaagaccaaatggaattcggcagaagcataaccaggacactgggttttggatctgtgactctccacacatgcagaggacaaaaatacaagagaaaggggtcaggagagaggcgtatgatggggggcgggggtgtgatgtgtgtgttgtgtgggtgttgtgtgtctttatgatatgtgtgtgtacacctgtgttgtgttgtgtgtgtattgtatgtgttctgtgtgtctgttgtggtgtgtgttgtgtgtgtgtgatgtgtctgttgtgtggtgtttgtattggtgttgtatggtgtgtggtgtgtgtgtgtctgtgtgtgatgtgtctgttgtgtagtgtgtatgtatggggtggtgtgtgatgtgtgtgtctgttgtgtggtgtgtgtatgatgtatgtccgttgtgtggtgtgtggtgtgtctgttgtgtagtgtgtgtatatggggtggtgtgtggggtgtgtgtggtgtacgtgtgtttgttgtgtggtgtgtctgttgcatgatatgtgtatggggtggttgtggtgtgtgtctgttgtttggtgtgtgtgtgtgtgtgtgtgtgtctggggggttgtgtgctatatgatgtggggaatggacattgactcagtgtgtggtgttgtctgttgtgtgttgtggtgtgtgtatctgttgcgtgttgtgtggtgtgtggtgcgtgtgtgtgtctggggggttgtgtgctatatgatgtggggaatggacattgactcagtgtgtggtgttgtctgttgtgtgttgtgtgtgtgtgtctggggggttgtgtgctatatgatgtggggacattgactcagtgtgtggtgttgtctgttgtgtgttgtgtgtgtatctgttgtgtgttgtgtggtgtgtggtgtgtgtgtgtgtctggggggttgtgtgctatatgatgtggggaatggacgttgactctgtgcgtgtggtgtgtgtgcctgttgtgtgttgtgtggtgtggtgtgtgtgtgtgtctggggggttgtgtgctatatgatgtggggaatggacagtgactcagtgtgtgtggtgtgtgtctgttgtgtgatgtgtgttgtgtggtgcgtgtgtgtgtctggggggttgtgtactatatggtgtggggaatggacattgactctgtgtggctggaaagtgatctttcaagagaggattaaccaaaggaaatgggaaattgaggtcaggatggataaggaaaacatggggcaaactgggtggtcagagaaagacgaggatggcctctaggctccaagagcaccccagataaaaggctggaataggggcaggagagaagccccccgtacagagggttattccagggcctgagggcatcccctccaccccagaggagtgaaggtgggaggaagtgttttctgcttaagcattgggaataaacgtggctgccaacaacagaaaacttgactggcaggtgtaaagaaatagtggtttctttgtctcccagaataaaaaatctggaagtgggcagggctggcatctgtggggttcacttggcctttccccatggaaataagactgcagcagtttccgtatcaggagtcttttcaaagcaggaagaaggcggtctgtcctaggcaccctccttccacacaggtcccttggccagaacaggtcacgtggtttctcccagttgcaaggtaggccggggaagcacagggcagttgccatgatccgtggctcaccctggctgaccactctgttatgccccaaacaaaagcagtttcattagtaaggaagaaggggacatgaatatcgggaagccagtcatgccacacgagaccctggggagcaaacatttttccttttgttgttgttgtagagctgaggtctcacaatgtcacccaggctggtctcaaactcctggcctcaagcgatccccctgactctcaaaatgctgagattacatgcatgagccaccacacctggctgataaacattttcaataaaggctaaattcaggtaatataatctcctgccctgcccactgcacagacaaatcaatctcgaaagctcagaggtatttcaagaatagtttggtggctggatgcggtggttcacgcctgtaatcccagcactttgggaggccgaggcgggtggatcacctgaggtcaggagtttgagaccagcctgaccaacgtgatgaaaccccgtctctactaaaaatacaaaattagctggaggtggtagcggtggtgggcgcctgtaatcccagctactcaggagggtgacacaggagaatcgcttgaacccgggaggcggaggttgcaatgagccgagatcgtgcactccagcctcggtgacagagtgagactcagtctcaaaaaaaaaaaaaaaaaaagaatagtgaatagtttggtggacaggggctataggaaacggggaatgttggttggttgggaatgaaaccatacgggtgtggaacccggtcctctgtgtgtgtgtgtgtagactgcctctgtgtgggggccacaggaccaactgagtcatgagtctcaggttgagtggagtcagccagtcagaaatgcgaaaagtctgaaaagacatctcaaaacaccagtcttaggttttacaatggtgatgttagctacaggaacaattggggaaattgaaaatctcatgacctccagaacaatggctggttaccctttatgcctacatctcagcagaatccaggctcttctcataatcctgatcttgtgtgctttcattcattttataagggtggtttagtttggggaagggctattatcatccttgttttaaggttaaacaataaacaaaattcctctcaaagttaccttggcctaaacccggcaggaatgacccaggttggagactggaggtaagacagccaactatgtcaaatttctcttactgtcataattttattttattttatttatttattcatttatttattttgagacagagttttgctcttgttgcccaggctggagtgcaatggtgcaatctcagctcaccgcaacctctgcctctcgggttcaagtgattctcctgcctcagcctcccaagcagctgggattacaggcccgcgccaccacacctggctaattttgtatttttagtagagatggggtttctccatgttggtctccaggctggtctccaactcccgacctcaggtgatttgcccaccttggcctcccaaaatgctgggattacaggcatgagccactgcgcctggcctttatttatttatttatttatttatttttaattgaaagagacagggtctcactatgttacccaggctggtctcaaacacctgggcttaatcaatcctcctgcctcagcctctcaaagtgctgggattacaggcatgagccaccattcagccattggtttcaataatattccaaagttgatctgaaagagcctccagaaagctgtgaggccccacattgggaatgcgacccaaaaccccaaggtcggggtcctgacccatttgtgcgatcatctcagtcaacattaattgtcttggtcttcttagcaacctcacgatgacagaaatgctattatttcccttgctacagatgaaaaaggaggggctcagacaagttcagaaactaggtcaatggccgggcgtggtggctcacgtctgtaatcccagcactttgggaggccaaggcgggcagatcacctgaggtcaggagatcgagaccagcctggccaacatggtgaaaccccatctctactaaaaagacaaaaactagccaggcatggtggcctacgcctgtaaccccagctactctggaggctgaggcaggaggatcacttgaacccaggaggcagtggttgcagtgagctgaggtcacaccactgcactccagcctgggcaacagagggagactccatctcaaaaaaaaaaaaaaaagaaaaagaaaaaagaaactaggccaaggtcacaccggctgtgagtggcagagcaaggggtgctgtccgcagaatcctctcttttcaccacgtcaccctttgcaggaggagcacatatgggtcaagatgttacgggctcaaccagcgtggtggctcacacctggaatcccagcactttgggaggctgaggcaggtggatcacctgaggtcaggagttcaagaccagcgtggccaacatggtgaaaccctgtctctacaaaaaatacaaaaattagccgggcaataataataataataataataatgaagtgatgggctctaatccagaccctcctcgggttttcagtcctaaactctttggctactccttacaggaagttgtccagttacacatctctgatccttccccaggatcaaaacccaggaaggaggccttgaagccagacagaaccatgttcaaattcccactctactacttggcagtgtgtggccttgggcaagttacttggctctgagcctcctaagcaggggtaacccctttgagaggttgtaggattcaatgggagaccatggattagcgccaagaaatagcaggtgctccataaatatccgtgcctttctggggatacagccaagtggaaactcagccatggacgatacctgggctcctgggagccaacatcactttatttcccacattctgctaacaaaatccaattcgttataatcaggggtcatctgttttgctttcctttgccaataaaaaattgacttggcatgaagtcttcagtagttacttcagctaacatttgttgaacaccgtccaggagccaggcaccctgctgctcagaggctggccctggccctctgggagttcagagtctcactgcagaatggcacctgcaggcaaagaactctaaaacaaggcagggtagtgagagatgtgagccatacgttcaaaatgctgggacttcagagacagcagaggccacctgggtgtggcatgggcttggcatgcagtcctctggggctactgcggaaggggtgtcaccaggaccagctacagaacttatggggcccctttttcaaaaagttattaagaatcttggtaataggccaggcgcggcggctcacgcctgtaatcccagcactttgggaggccgaggccggctgatcacctgaggtcacgagttcgagaccagcctgaccaacatggagaaaccccgtctctactaaaaatacaaaattagctgggcgtggtggtgcatgcctgtaatcccagctacttgggaggctgaggcaggagaatcgcttgaacccgggaggcgcaggttgccatgagccgagattgcgccactgcactccagcctgggcaacgagagcgaaactccttatcaaaaaaataataataataataatttcagtgatagtagggcattaagccaaatgtagggccctctgagcatggcgccctgtaccaccacacaggccactgacccatgcagctggccctgggtgccgctattccatgaccccaggaggtcaggtgctgtccctctgggagaggcaggctcagggcagaccctgtgggagttgggccctcaggcctcatccaagctgctgaccatgcgtcacggctccctatttctgtgtgaggagaattgttcctgtctggtgactgtcatcaggagggtgactgtggatttccacaagccaggatggacggcaacttccccagcatgagaaagagccacccaggattggcttggggctgttgacagtggcctgtccctcgctatgtcatctgcctcaccacaaaccaccagcagaaggttcagaggccagggaaagagaggggagccactgggccaggcctgatggtgcacacctgtcatcccagcactttaggaggctgaggcaggaggacggcttggacccaggagttggagactagcctgggcaatgcaatgagaacctgtctctccaaaaaaaaaaaaaaaaaaaattaaaaacttagccagacatagtggtgcatgcctggagtcccagttactccgaaggctgaagtgggaggatcgtttgggcctgagagtttgaggctgcagtgagctctgatcacaccaccgcactccagcctgggcaacagagcaagaccctgtcgcaaaataaataaataattttttttttttttgagacagggtctcacgctgtcaccaaggctggagtgcggtggcgcgatctcggctcactccaacctctccctcctgggttcaagcgattctcctgcctcagcctcctgagtagctgggattacaggcgcccgccaccacactcgctcatttttttgtatttttagtagagatggggttttgccttgttggtcaggctaatctcaaactcctgacctcaaatgatccacccgcctcggcctcccaaagtgctgggattaaaggtgtgagccaccactcctggccataaaaatttttaaatgacattttttggctactgttaaaacaacaacaaaaacaggaactaagaagtatcggggaggatgcggagaaactgcgcccggtgcatcgctggtgcagaatcaaatggcgcagccgctgtggaaaccagtgtggtgggaggctcctcaaaacattaaacagacaattaccaaacaatctcgcaatcccgcttccgggtatatgccccaaacaactgaaagcagagtctcagagcagtatttgcacgcccacactcacacagcattaccacaagagcaaaaagatggaagcaactcaagcttcacggacggacaaacggatgaaccaaatgggttatatgcacaaaatggaatattatgcagccttaaaaaggaaggatattctgacacatgctgcaacgtggataagccttgagaacattatgctaagcgaaataagccagctacaaaaaagacaaatattgtatgattccacttatacgagtaatcaaattcccacaaacagaaagaaaaaagtggttgtcagggctgggaggagagggaaacaaggagttattgttcaatgggtgtaacatggcagtttttttgtttttggggggtggttttgagacagagcctccctctgtcacccaggccggagagcagtggtgcgatctcagctcgctgaaacctctgcctcacaggttggagcggttctcctgcctcagcctcccgagtagctggaattacaggcacgcaccaccacgcctggctaatttttgtatttttactagagatgggggagttccaccatgttggccaggctggtctcgaactcccaacctcaggtgatccgcccgcctcagcctcacaaagtgctgggattacaggcgtgagccaccgcacctggcccacattgcagttttgcaagagcgagacttctggagatggatggggtgatggttacacaacaatgtgaatgagcttaatgctactgatctgtacacttagaaatgactaagatagtacattttatgttatgtgtattttaccgcagttaaaaatgttgtaagtttaatgacttttgttttctgtatataaaaaaatatttattaaaaatcgtgagcccaggcacagtgactcatgcctgtaaactcagcactttaggaggccaaggggggaggatcacctgaggccaggagtttgagaccagcctaggcaacatagcaagaccctgcctctacaaaaaataaaacataaaaattagctgggcatggtagtgcacgcctgtagtcccagctactagggaagctgaagtggaaggaccgcctgagcccaggaggtcaaggacgcagtgagctgtaattgcaccactgcactccagcctgggaaaataaataaatataaataaatggcccaggcgcagtagctaatgcctgtaatcccaacactgggaggccaaggcaggcagattccttgaggccaggagttcgagaccagcctggccaacatggtaaaaccctgtctctactaaaaatacaaaaattagacaagcatggtggcacatgcctgtaatcccagctactcaggaggatgaggcacgagaattgcgtgagccggggaggcagaggttgcagtgagctgagatcctgccactgcactccagcctgggcaacagtgggaacctgtctcaaaaaaaaaaaaaataaatataataattaataaataaaaatcttgaatgtataggaaaaccgaaagagggctgggtgtgatggctcacacctgtaatcccagcactttgggaggctgaggcgggcggatcacctgaggtcgggagttcgagaccagcctgattgacatgagaaaccctgtctctactaaaaatacaaaattagccagctgtaatcccagctactcgggaggctgaggcaggagaatcgcttgaacttgggaggtggaggttgcggtgagctgagatcgcgccactgcactccagcctgggcaagaagagcgaaactccatctcaaaagaaaagaaaagaaaagaaaaatccaaagaggcaaagatgtaatatctctcttatattatacataaatactcataaagaaataaaagtacctgtaactctactacccagagacaactgctgctaaagacatgatctacttcctcctgtatttggaacacacacaggtgtgtacctctctccagccatctataattcagatcagttcaacagctatagttatgtatactctatttcctcctgtatttggaacacacacaggtgtgtacctctctccagccatctataatttagatcagttcaacagctatagttatgtatactctatttcctcctgtatttggaacacacacaggtgtgtacctatctccagccatctataattcagatcagttcaatagctatagttatgtatactctatttcctcctgtatttggaacacacacaggtgtgtacctatctccagccatctataattcagatcagttcaataactacagttatgtacactactttctcacttcatgtattataagtatttctaaaatctcctgtaatatgatttttagtggcttcctggtatttgatcatatggacataatgttcaactaatcttctatttctgaacatttaggtcgtttaaagtttttccgtgttttaaacaatactgtgatgtacatccttatgtatatactgttatccatatttctcgaactcctgacctcaggtgattcgcccgccttggcctccaaaagcgctggggttacaggtgtgagccaccacaccccgccctgttatccatatttctgatcatttccttagggtgatttcccacaagacatttcaccgagtcaaagactgagtgtcttgaggccaggggcacgtacggatcgggccctcctgatgacagggccgcgtctggcccagtgctctgtgctctgtgctctgtcccctccaggcttctaaggccccagactttctctcctttgactttggctagattcgactcccgtaagtgctggcgaacgaaaagttctggaatgtaagcaaaatggggcccccgtgtccatatgggctaactctgtaggctcaaatgaaatcttttttttttttttttttttgagacagagtttcgcccttgtcactcaggatggagtacaatggcgtgatctcggctcactgcaacctccacctcctgtgttcaagcaattctcctgcctcagcctcccaagtaactgggattacaggcatgcaccaccacatccagctaatttttgtatttttagtagcgatggggtttcaccatgttggccaggctggtctcaaactcctgacctcaagtgatccacctgccttggcctcccaaagggctgggattacaggcttgagccacctcgcccggccctcaaatgacatcttaaggccgggtatagcagcttacacctataatcccagaactctggggggctgaggcaggtggatcacttgagcccaggagttcaagaccagcctaggcaacatggtgaaatcttgtctctacaaaaaatacaaaaattcactgggcatggtggcatgcgcctgtagtaccacctacttgggaggctgaggtgggaggatcacctgagcccgtgaggttgaggctgcagtgagctgtgattgcaccactgcactctagcctaggtgacagagagagactctgttgaaaggaagagagagagagagagaggcagagagagagaaagaaagaacaaaaagaaaagaaagagagagaaagaaaatttacaaaaaaactcaatttctgttgcaggaagaggcttagagattgcctcctcccactctttcattttatgaagcagaaaaatgagggccacacatggcatcagctattcccgtttcttgatggacagactgagctggaactggcttggtccatcaccccagggagtaatggctggcttaacagcccacagcaaattctgtggttcactggaccaagcagcaggttccaggacagctgtggggtcagttggggccatctttggactcagcctgagtgtcagctgtctcatgcccacatcctggcactcacaggagccagtaaaactctctccagggcagtggctgcgaccctgtctcctaaactcagaaaaccaggtcctaactttggggacttgcggggaagggtgggagggggtcgggggataaaagactacaaatagagtgcagcgtatagtgcttgggtgatggttgcacccaaatctcacaaatcaccacgaaagaacttactcatgtgaccaaatagcacccgtaccccaataacctatgggaacattcaaaagaaaaagaaaaccgtgtcctagtctcctcagccagtggggcggtgtgtggtgggtggtctgcacttggtcccagagaggtcaatgagacccagacttgcctgtgaaagaaacggagtggtggcggggcccgggaaaaacccctgcgttcactcgttcactcggcgcctgctgtgtggcaggcagcccccctgctgggctcgctcagtcctcggtaccatcctgggagcaggcattagcccccttttgcagatgagcctccgaaaaggtgaagaacttgaccaagggtcaaactgagcaaatggcagagtcaggcccctaccccggctgaccacccaatgcccagtggctgcagcgttcccgttacacagcacgatagctctgcaacacacataagcatgcattaaaccagagatgcgccatcactcccacttctggaagctgatctcatagcacagcaagagacgagcaagaaggatgttctaacaagtgtgttgaggggtcacagggtgggcctttctcactccaaggctctgggactcttggagctctggtaggagcaggggagaccaaccctacctcggatgcaggggcagcatccgatgaccctgataatgaccacaagaaagaggcagcacctctagggcaggaaagtgctgggggtcagaggcatgggtgccattccaggctgagccaggctggctgtgtgagcctgcgtgagtcacttaacctctgaacctagtgcttcacgtgcaaaagagggaagcttccctcatcctcctccagccgtcacccgctgccttccttctctctgcagcaaaatggctccgaagcgttgtctacacttcttttctctgattctttatttaaatttgcacttattaggctgagcgcagtggctcatgcctgtaatcccagcactttgggaggccgaagcgagcagatcacttgaggttaggagttcaagaccagcctggccaacatggtgaaaccctgtctctactaaaacacaaaaattcgctgggcatggtggcaggcacctgtaatcgcagctactcaggaggctgaggcaggagaatcacttgaacccgggaggcagaggttgcagtgagccgagatcgtgccactgcactccagcctgggccacagagcaagactctgtctcaaaaataataaataaataaataaataaataaatcttcacttataaattactccctaaataaaaataacacgttatatacatatatatacccatctcagcctcccaaagtgctgagattacaggtgtgagccatcgtgctttgccataacgtggtttttttaatgttttattttaaaaatgtttttataacttttatctatttatttattttttgagatgaagtcccgctctgttgcccaggctggagtgcagtggcaccatctcagctcactgcaagctctacctcctgggttcaagcgattctccggcctcagcctcccaagtagctgggattgcaggcatgtgccaccgcacctggttaatttttctatttttagtagagacaaatttttgccatgttggccaggctggtctcaaatccctgacctcaggtgatccgcccgcctcggcctcccaaagtgctgggtttacaggcgtgagccaccgcgcctggacaaaatttttttataccttttaaattccagacccaccaccaggttgaatcctccgggctgactgtgcagaccccccactatgccccctactttccattaactggtatgttttatgttatcaagaatattaaaacaaacctatgcatctgccattgagcttaagaaatagatggccggacgcggtggctcacgcctgtaatcccagcactttgggaggccgaggcgggcggatcatgaggtcaggagatcgagaccatcctggctaacacggtgaaaccacgtctctactaaaaatacaaaaattagccgggcgtggtggcaggcgcctgtagtcccagctacccgggaggctgaggcagaagaatggcgtgaacccgggaggcggtgcttgcagtgagctgagatcgcaccactgcactccagcctgggcgacagagtgagaccctgtcttggggaaaaaaaaaaaaagaactagacgaatgcccaggcatgggaagccccagtcacctttccctccctcaacccgagaggagtcacattccaaacctagcctttatcattcccttccttttcattagacggttatgtatgtacgtatccttaaactttatgctaatggtatcacattttgtgtattctactacttttaaacatttatggattaaattctgtccctccaaaaaagatatgttggagtcttaacccctaatactttaagccgtgaccccgtttgcagacaccgtctttacagaggtgctcaaggtgagaggcactcattagagtggaccctcattcgatacgactggtgtccttataacaagcagaacacaggacagaggcagagccaccagcagggagaacaccacatgaagcctggagtcaggcttccggacgaagccgggagagaggcggggaacaggtcctcctcccacgccttcccagggaacgtggccctgtcggcaccctgatctcctcgcccctagaactgggagacaacacgtttctgctgtccagccacccagtgtgcggtactttgttacagcagccccaaaaaataaagacaccattccatgtcatgttcttgaaattcatttgttaatgagtgaagccgaggctcattcattttctctgtcatgttctattatatgatatcccacaatttatccattttactttgaaaagttatatggtttgcttacaggttttattgttgttttgaaattgcaaactgtgctgccccgaacctccctgcaaactgtgccgtaggagtggagctgcacttgggtcaaagagggcaaaggtaagtcttaactgtgcagcccagatcagagcaataacaactcatcaagataagtctaattgctactcaacggggtggaacttacacgcttgccagtgggcaggcagagttccctgtgtcctacattcttgttaacacttgaaactccagtcttttttttttttttttttttttttttgagagatggagtctcaccctgttgcccaggctggagtgcagtggtgtgatcttggctcactgaaacctctgcctcccgggttcaagcgattctcctgcctcagcctcccaagcagctgggactacgggctcccgccaccacgcccagctaatttttgtgtttttagtagagacgaggtttaaccatgttggccaggatggtctcaatctcttgacctcatgatccgcccacctcggcctcccgaagtgctgggattacaggcgcaagccactgcaccccgccctgcagttttgttttgtttttttaatttattattttaaaaaaatgtttttgagacaggatctcactctgccacccaggctggatcatggtggcatgatcttggctcactgcagcctcgtcctcccaggctcaagtgatcctcccgcctcagcctcccaagtagctgggaccacaggtatgtgccaccatgcctgactaatttttgtgctttttgtagagatgagttctcactgtgttgcccagggtggtctcaaactcctgggctcaagcgatcttcctgcctcagcctcccaaattgctgggattacaggcatgagccaacacacccagcccgaaggaactgccattctttttatctttgccaatctgatggttatagaatggtatttcctagtggctttattttgcgttttctttatttctaataaagttaagcatcttttacatgttgatggacaatgtatatttcctgttttgcaaaacacctggtcgggttttcctggtcttttttcttatttatttctaggagttctttatgtactctggactctgatcctgcattggtctttctaaagctttattcgtcgcatcctctgatgaacagagcttttcttttttcttttcccttttaaaattagtagaatttattcatctttttcttaacaattagtgctttcaagaaattctttgtacccccaaggtcaagagatattatcctatactcgctttgtaagggttggtattctgcctgtcaggtcgttaatggacctggcattgattttggagcctgctgtgtagtcagatctaaactgggaaaggaacaattgcctgcttttctcacaggggcgttctgaagctcaaaggagaaaatgcgtgtgaaagtgtccagaactgtgaaacaatgtacaagtaagagagtctgcgatgctgatttgctggagggtgacaaagccgtttaagagaaggctgctttggcctttgatttgctaatcagttggtagcgtcataggctgccagtaggccaggcagaaacccaacctccattctgcctccggaggctggagaacacagccaaaaagaccagctgaagcatgtggtctttgcaggaaagtaagttccagtggcactgctggggctggccccgtccacccacactgttcactccatctgccacctgacattagcaaattaggctgcaaatacagccctgagtcatagagaaaagatgaaattacactcaggaaactctgctcactgaagtgcatgagtaacaggatgcagaaagacacccattaaaagcggctaaaaacgagtcaggtgctccaaggcagcctgctgcacaccccaacacgcgggcaggctccgccccagctccaactccacctggaggggcaacacgcacccattatacgagccacacgggggccccagcaactggcccagacaaggctgcagagcccactcagggtggaaccccctttagcgaactggaaggttccatgacggggctgcggggaaggaagccgactcgtggggagttagctgagctgccggaggaaactgacaaaatcaaacgcaccctttggcctgcacaaggcgatattgttggttctccctgaagcacatcctggccaggagacagagcttaggccagcccccgggccaggtgcctgctacccagacctgtgatcctagccaaaagtctctgagttctggatgtccacactgggaagggagagcagcgagggaagggttaccaaaggggcctgaggagacattcgggggtgacagattgtcagcatctttttgtttggtttttcttttaagcgatgggggcggggggtgggggggggtctcactatgttgctgaggctggtctcgaactcctggcctcaagcaatcctcctgcctcagcccccgagtaactggaattcaagacgtcagccacggcccccagcttagcttcagcatcttgattgcagtggtggcttcacagatgtatacatatgtcagaacttatcaaattgtatattttcaatatctattttagacaattagatctcaataaggctgtttaaaaattacagaatggtgtgatggcgacttttactaaatatgcatgttgacagcaagaggaacgactagaaggaggtccccagatgttaacagtgcttagttctgggctgtgggattacagaggattttacttttcctctttgtgtttttctgtactttaaaaaatttctgaaatatatgtgttttactttttttttttttttaagatggaatcttgctctgtcgcccggagtggagtgcagtggcgcgatcttggctcattgcaacatctgcctcctgggttcaagcaattctcctgcctcagtctctcaagtagctgggattacaggcatgtgccaccacacctagctaatttttgtatttttaatagagacaaggtctcgccacgttagccaggctggtctcgaactcctcacctcaggtgatccatccacctcggcctcccaaagtgctgggattacaggcgtgggccaatgcgaccagccgtgttttacttgtataaatcaggaaaaaaaaaagtatctatttcaaaataaaagcaaactttaggtcgcaggggtcttctgaaggtcggcagccatgacctcacagaggcacactctgggcttagcacggtggagctgtgcccaggggaagcagcttgggctttacaaccaggtctgcagcaaactgcccaggccaaacctcagctctgccgcccatctcctcagcggccttcagctagttacttgagtgcttggtgccaattttaatccccaattatatttcggagacaatcgtcaaagcctctgcaggtggctgagagattcaatgagccaatacaggtggctcttagcagtgttctcacagcacagcacagactgggtgaattacagctactattccctcctattaaaaagaatagaagtggccggacacaatggctcatgcctgcaatcccagcactttgggaggccgaggcgggtggatcacctgaggtcaggagttcgagaccagcctggccaatatggtgaaaccccatctctactaaaaatacaaaaattagccgggcgtggtggtgggtgcctgtagtcccagctactctgaaggctgacatgggagaattgcttgaacccaggaggcagtggtttcagtgagccgagatcgcgccatcgcactccagcctggatgacacggcaaggctctgtcccaaaaaaaaaaaaaaaagaatagaattgacttgagaaactctttgcttctttttcccccatgaggttagaaaagataattgaatcatctctagaacaggacgccagtttctggaactgaagggttttgaggtttctcttaacgaatatcagaaatctttatctctcaaccaactgtaaccaccatctgtggcctcctccagccctcaccaatacgggtacccctcccaggcttcctctccctccctgagcctctgctgtgaattatctgagtccacttcttctgaggctgcttttatgggacagagacaagaccctactctttccttctcttacttgttccttttctgttgtctgccagaagtaaccacccgttgcccaaaccaatctttagcttggcctcctttcaggggtctggatgccatctttaactgccttagtctggtggcctgagcagcttacctgagcctcagcttcttttttctttttctttccttttttttttttttttttgtttgtttgtttatttgtttcttgttttttctgacaggatttcacgccatcgggcaggctggagtgcagtggtgcaatcacagctcactgtagcctcaacttccagagctcaggtgagcctcccacctcagcctcctgagtagctgggactccaggcacgcactcaatgcctggctaatttttgtgtttttggtagagatggggtttctccatgttgtccagcctggcctcaaactcctgggctcaagtgatccgcccaccttgacttctcaacatgctaagattacaggtgggatcctaccaggtggggcaggagtaatcaaccctactagacagatggggaaaatgagaggccgggcgcagtggctcacatctgtaatcccagcactttgggaggccaaggcaggcagatcacttgaggccaagagttcgagaccagcctggccaacatggcaaaaccccatctctactaaaatacaaaaattagctgggcatggtcgtgggcacctgtaatcccagctactcgggaggccgaggcaggagaattgcttgagcccgggaggcagaggttgcagtgagccgagatcgcaccactacacactctagtctggatgacagagcgagacttagcctcaaaacaaacaaacaaacaagtgcacctttgttagttttatttgaaccaatgtttacatctctggcaaccacaggctcatatgaaacttcatgctattaaactttatgggtgacatggccaggcacggtggctcacgcctgtaaccccagcactttgggaggccgaggcaggtggatcacgaggtcaggagatcgagaccatcctggctaatacggtgaaaccccgtctctactaaaaatacaaaaattagctgggcgtggtagcacatgcctgtagtcccagctacttgggaggctgaggcaggagaatggcgtgaacccaggaggcggaggttgcagtgagccgagatcatgccactgcactccagcctaggcgacagggcgagactctgtctcaaaaaaaaaaaaaaaatttatgggtgacaatagaacaaaggcagagggacaggacagaacaatgagtcactccaacacaccctgtgtgttctaaaagaggccccgggacaaacacctgcctcagtaggaaggtccagcattcgtggcggtgtgtgctgggcggttgtggtgaggactgtgtctgtgtctgggcgggtgtgtgtagttgtggagtttatagctttcctttgactcaaatccttcttccctatcaccggcttacatgttagaggcctgtaacaggagaccagttccaggccaacctgtggttaaaagaacctcagcctgtgagcaaatgttactcctcctccgcactcgaggaccctgtggcagcccagcctgtcaggcctctgcagacatgagttggcctggttctccctgctgccatccctcacccgccaatccccaatcagtcttcactgtataaacaagtgcttcactgaacagcccagcgcatctgcgaaagatccaacacgcagcccttctcgttcctttgagtggatccatttgaaaagctcctgtctcctggctgggtgtggtggctcacgcctgtaatcccagcactttgggaggccgaggcgggtggatcacgaggtcaggagtttgagaccagcctggccaacatggcgaaaccccgtctctactaaaaatacaaaaattagccaggcgtggtggcgggtgcctgtaatcccagctactcaggagactgaggcaaaagaatggcttgaacccgggaggcggaggttgcagtgagccgagattgagccactgcactccagcctgggcgacagagcaagacaccatcaaaaacaaaacaaaacaaaacaaaacaaaacaaaaatctcctgtctctaggaccaggcacaatggcctaggcctgtaattccagcactttgggaggtcaaagtggaaggattgcttgaggccaggagttcaagactggcctgggcaacatgatgaaaaccccctctctacaaaaaaattaaaattaaacaaatcagttgggcagggtggtgcacctgtagtcctagttgctctggaggctgagacaggaggatggcttgagcctgggaggtggaggctgcagggagccatggtctctccttcacattccggcctgggagcaagcccttcatctctaaaataataataataataaaataaataaataaataaataaataaataaataaataaactgtctccaaatccttccattctagtccaggcctcttttgagttagctctattttttcctaatactcattaaataaatgcttaactattaaaatagaaagtcctctgggcggggaatggggtggggggcggctgccaggccatggccagaggctattatgcactggaaaccccgcatagcagaggggcagccctgcacctgcccctgtccaaggtaggtgggtggtgactgcaggccatgggaaacgtccatcctaggggagtcaccagccacctgggaagccaggatcaaggccctccacccccagagtacaggagacaaagggaggaacaccagggacaaggaaccctaggacccgaagcaaagtggcgttcgctcacccgggagtgccacgttcgtgccaccgtcacagccctcacctcccgcccgccagcacctgagaccggagtgctggggggctggctgcaggcgaaggaggtgagggcggattcgtttctcactgcaactgcagcctctagagctgggtgggcagggtctggctccatgagctcagagctgaccctctacaaagattccaggacttgggggctggagacatctctcttcgaaaacagattaatccagaggagctgtgggccctgtgtttagtaaattgtactctgtgtcttcagcatagaaagtccttcccactccctgctcagtatctcccagccctcctaggaggcaggcaaggcaactccaggacagtcaccctagttcacagatgaggaaactggggtttcaagactgagacatgagcgctcagcacagtccggggtggggggcagcaagggggtattactgagcacctctcatgcactgccacagccccagaccttaccccacttcatgcctgggacagcccgtaagctgcggactactggccaggtaaacaaggggaagaatcctacccaagatgtagctgatttgaatttgttaagaattaaggccaggtgtggtggctcacgcctgtaatcccagcactttgggaggcagaggcagacgggtcacctgaggtcaggagttcgagaccagcctggccaacatggtgaaaccccatctctactaaaaatacaagaaattagccggacgtggtggcagacgcctgtaattccagctactcgggaggctgaggcaggagaatcgcttgaacctgggaggtggaggttgcagtgagccgagatcatgccactgcactccagcctgggcaacaaagggaaactctatctcaaaaatataaaaaaattttaaaaatgtaaaaattatggcagccccaatttccaactaagttatattccaaggtatagtcaaaacacattttcccactgcaacaatgttattttatttagatattggggcttgtccatcaagggccagttaacccacaacactccagaatttctgaacaagtgtaatgaacagctgacaaatattattacaacatcaatggtcaaaatagaaaagcaatagcatttgataagaaattactttttttttttttgagacagagtcttgctctgtcacccaggctggagcacagtggcacgatctcggctcactgcaacctccacctcccaggttcaagcgattctcctgcctcagcctcccaagcagctgggactacaagcacctgtcacgacgcccggctaatttttgtacttttagcagagacagggtttcaccatgttggccaagctggtctcaagctcctggccttaaatggtccacctgccttggcctcccaaagtgctgggattacaggtgtgagccactgcatccggctgactttttatttaatatcttgaatacctgcctgaaaatctgaggccggatggaagaatggacagaattgcccccactctcctgttctggaatttaaagaagaaaaaagaggggaggaggcatcacctagttgggaccaggcttggggaaaaaaggacagaatttgcagaccaaacagggaagctgtgaaagaaaaaagcaagtccctggcaagcagctcagcagctggaaatccccctcggtccttgggagagacaatgagctccagctgctctcaactgcgatgcagagagagctggttcccaccctgcagccgtccccgtgtccttctcctcgctgagcctcacctcctccgcctgccacagaggcgagcatcccgcttcctgcccagggatgcagcggagaatgaatatcacctaggtaacaactcacaagcacagtgtctggcttcggggcgtaggggcggggacacatgtaatcaatacaagccgcctgcctgggtggcttcccccttccctgatgaagacctccaggccgcagagaatgctctgttcctggtcacaaggctgcagctgaagggcgggggaggcctctcagattcaaaacagagcagagatgagaggcctaattctaatttgagatcagagcctgacagctgggcaggtggcaggcggccgcttcctcccctccgtggagcctgccaggagaggggctgtggtcgtattaagggtgtgagtggcaaggcccgcagcgggatgggcagtccccgccatgccagtgcagctctgtgtaaatccttagtcccgagtatcctcgtgtaactcagagctggaaagagccgtagatcttctggttccatgctttcattttacacataaggaaacaggcccacagaggaaaagggctttttgtagtcacgtggcgaggcaggggaagctgggcccagaatgcaggggacctgccacccagacccacagccaggaccccccaacgggaaaacgctcgctcggccaccaagagcatttgatgaatttgcctctagtcttttaaaaatacatatatgcaattttattttaaaatgttttatttttattttattttattttttttgaaacagggtctcactctgtcagccaggctggagtgcagtggcatgatcatggctcactgcaacctccacctcctgggctcaagcgattctcctgcctcagcctcccaagtagctgggactactacaggcaggcatgtgccaccatacttagctaatatgattttttgtagaaatggggtcttgctcacaacaaagcccaggctgctttaaaattcccttgctcaaatgatcctcccacctcagcctcccaaagagttgggattgcaggtgtgagccactgcacccagcctacatgcaattctattttattttttttattttttcattttatttttgagacggggtttcgttctgttgtccaggctggagtgtagtggcgaaattaaagctcactgcagcctctacttcctgggctcaagtgatcctcccccctcagcctcctgaatagctgggactataggtgtgcatccccatgcctggctaacttttttctatttttttgtagagatagggcgagccactgtgttgcccaggcaggtctcaaactcctgggctcaagcaatcctttcatctcggcttcccaaagtgctgggatcacaggtgtgagccattgtgcctggctgtaattttaaattaatacctaattatactatgcatgaatacattctctttaaaaagttatttccttgcctcttggatatggtgtggctacttagtgtttgttaaatgtgtgaacaggtgaattcttatttctatcatcccattcaggccccaatcttattaccagctcctccctggatgccagcacctctcaacgccccctcccctaggaccctcctaccaggaccactggatcagggcacccaggggcaaggaggccagtgaggctgcttgagggcccctctaattcctgccccgctcttggttggggctagctttggggcacactttggacttttttttttttttttccagatggagtctcactctgttgcccaggctggagtatagtagtgtaattttggctcaacctctgcctcctgggtccaagcgattctcctgcctcagcctcccaagtagctgggactacaggcacgtgccaccacgcccggctaatttttgtatctttagtagagacggggtttcaccatgttggccaggctggtctcgaactcctgacctcaggggatccgcccgccttggcctcccaaagtgctgggattacaggcgtgagccaccacgcccagccctttggaattttttatcccagccccaagcttgggacgggtctggggcacccagataccctccctgtgaagccagggccccccgccctgctcaactgcctgcacacaagcaggtgttcctccttctctgtggctcctctcacctttgcttcctctctcccggtattgggacgtggaaagacattaaacacctgggagcccccagggaataattcaaattcaatcatagaaaatgaaggcacaaggcctgggctgctgggagggcccgagggcctggagatggaggcttggcaggcccagcactgctgaagccaagggaatgagtgacttctccaaaagcaggttgagtcatgctgaacctcactggttccccagtagcaggagcatgaggaccaaggacggacctagaagattcatggtaggggctgaggggaagagcagccaagagtcaggagggtcagaagtgtgtctgatcccttggcagggtgcggtggctcacgcctgtaatcccagcactttggaagtccgaggcgggcggatcacctgaggtcaggagttcaagagcagcctggccaacatggtgaaaacccgtctctacttaaaatacaaaaattagccgggtgtggtggcgggcgcctgtaatcccagcaactcagaaggctgaggcaggagaatcgcttgaacccgggaggcggaggctgcagtgagccgagatcgcgccaccgcactccagccagggtgacagagcgagactctgtctcaaaaacagcaataacaacaaaagaagtatgtctgattcctcaggccagagtaaaagaggtttcaagaaagagggtgtggtcaacagtgccaggtgcagctaatgtaaaggaaaagtggcctcctttttcccttgacgtggatgcgtacaaaccctcccctgggaccaagctcagggccgggccacgaccaggggccctcaggctagatctggtgccggaggagacctgctgccgaggctggacgggtgagcctggaagggcgtggaccctccacccaacctcagggacaagtgcctgacacccccctgagcagaaacagggtgggacggaaaccaaacaaattgctcctgaaatccatgttttaggaatgtttggttttcagcttctctttcctgcagcaggatgtttaaagaaaacaaatctttaaagtcttctactccaaagcaaagagcgctgtgtgtgcctacttctggtctccgcttcaggaacaaaccccctttactctctggcctggattgggcgcaaggcagccggagcttcctggccaagctgggccagcagcccaggcccccaccaaaggctcagagtgagctgggcaccaccaggccttgaggccttccagaggcttctactccagggcactctgaggccgggggctgtgggtggctaacagactatgccgccagctgggagcagagggggccccatctctgccccaaatccaagtctggccagctccttcccctagggatagatacttggtggggaagagagggagctgagaaggtcacccaagaaaggtgagccgggccgtctgcctgggagtcagaatgaggtggcccatcctcggacttgaccatttcccaatgccctgtttaatttaattttttattttattatatagggacagggtctcaatatattgcccaggctagtctcgaactcctggactcacatgacccacttgcctcggcctcccaaagtgctgggactacaggcatgagccaccacccccaccccccagataatctaaattcagagcctgcaaaaggctcagggcccaaggagagaaaatggagacagaagagaaagggaatttctccctccaggtccccacgcctgagtcagaccctctcactgtttcctttacaaccaccgcacacccacctggacctggcctaagaaaaggaatacaagtccatgaaggttctcccttctttttcttctttttcttcttctttttcgtcttttcttcttcttctttttcctcctcctcctcttcttcttcttctttcttcttctgtcgcccaggctggagtgtaatgacgcgatcttggctcacggcaacctccacttccgtatctcaaggaattctcctgcctcagcctctgggactacaggtgtgcgccaccacacccggctaatttttgtattttttgtagagacagggtttcgctatgttggccgggctggtcttgaactcctgacctcaggtgatccgcccacctcggcctcccaaagcgctgggattacaggcatgagccaccatgcccggcccatcatgtacccttctgatcctacaagcgcactgtgaggtcggccgggcatggagtttggtttcaacttcacgttgagatcggagcagctctgagaggtcggggcttcatccagggccacacatccagctggcagcagagccacctgtccacccagctctccggatgcccggcctgtgctccctacacagccgcttactgccctgccaggaaaaggcaggcaggagggatctttccactcccattaggggctgaggaacaggcatctaggagctaaatctgactgggggagtctcccagcccagacagcccagggccctgcccaggggtcagtgctttcacttgctgacctcatgcctccaccactactcggggacagatgaggttcagcatgactcaggttcagccaaaggatactaatgggccatggaataaatcctgcctggagccctgttcacctcaggacttgtcctcagaccatggaccttcctccctggtcactcagtcaaggaatcgcaggagatcagtgcaagagtagctctgaatgggccgggcgcggcggctcacgcctgtaatcccagcactttgggaggccgaggcgggtggatcacgaggtcaggagatcgagaccatcctggccaacacggtgaaaccccgtctctactaaaaatacaaaagattgtccgggcgtggtggcgggcgcctgtagtcccagctactcgggaggccgaggcaggagaatggcgtgaacccgggaggcagaggctgcagtgagccgagatcgcaccaccgcactccagcctgggcgacagagcgagactccgtctcaaaaaaataaaaaaataaaaataaaaaacagtagtcctgaagcccccagcccagcacacctggtctttgcaggcccgagacacccacaagagtaacagcagcgcctcattcaggaggctgaggactaagtgagcaaacgcaggccgagtgcttccccaggcctggacctccattagcattcaactgtgttgtcattgctgtcattgctacactggagtcagatcactaggcctttaggaggaagaacgtgcccttcctgttgacaggccgggcctctgacccaggcgtctcctctccgtggggtggcaggaagggcccaggactcaggtggcagatcagggaccccctggcctggcctctgctcagctgtgtgatcttggggaagccccgccttgcgtcccccaccgccttggttttcttcttgctgagaagtgagggaggtggctggctgttcagcagggccccttccactttgggaatccccagtttcagcagcagaacttccccaagcagaaagctgctgggaaagtgggtgcccaggtgggaggcggaagccccagggagaggcagacgaaggtgccctgtgcgggccccgcctccagcctggtggacagtgccctgggtttccatgcccagaccagggccttcctggaaccgcagccaggacgtgagaagctgtcagacagctgcctctgtgttcctggaagctgtggttcaggaaaagtgggagggagagaaggagggagagagcaatcgagggagagcagaagagtgtgaagagaaagagaaagacaggaggaggagcaaggggaagggaggaggcaagcgtggaaaggtgagaagaggtgaggcagaggcctacgtggagaggcagagcctgggacgctgcctgcgggggaggtcaggtgaggagcagggagggcggaggctgtgagcagccaccctggaacagagctcggaacaccattgcttttgccttccttcagcctgaaacactgcctggccacaaagcagaagcagcagttgctttcttaacaggaggcagagccgttgttgggtgaccctcttctcattcccttgaagaatctcagcccatgcccccatcccttctggcctggagacaccagtgttggggagttttgtgtaaaacagtaacaaagacctcgtgtccgaagcagcaccctttacctctgttgtcagggccacagggaaacccgcacccagccggacaggagtcagaggctgttgtcatggtaactggcatcccaaggcctggtctgcctcctgcctcctttatcgggctatgatggtcactgcttcctctgcgaagcacctgtcatgtgtgggggtttgtgccaagctctttccatgcactaggtaagccatgtcataaccacacgatgagatacgacttgtgtgtgtgtgtgtgtgtgtgttttcttctagagatacaattattaatcttacattacagggggagaaaccaggcagcccaccttcagagcccgcgtcttaactgtgaccccacgttgaaataaaatgtggaaactgcccacagacacacctcgtggtggctacgagtcacaggggctgcacttctgcctcttggggagttgcttgtttgctccatgctggtttcctcacctcagaaactagaataacagttccatagagcagtcgtgaggattgaaggaggcagcctggacactgagcacaggccctggcccaggcagggctccatcgagggtttgttagtacaggagttctggcgagccctcagccgctgggctgcttccctccagccattcctctgcatgctaagaactaaagagaagggagtcagacccagatggagcatgggtgtcaggcactgtgcccagctgcccatgagagccagcaaggtgcctgtgtcctttgaggtactaggattctgggccctggatcctgcagtgcggtgacctccccttcccccatctgtccctgccctgctccaccctcagccacctgcagggcccccacccaagggtcagggcagagcagggcagagcagggcagagcagggcagggctgagtgggaggcagcggagggggtcattatcaccggcagcacagggctgaagagagttaaaccttcttatcagttccctgggcctgtgcccagcccagcccagctctgaggcacaggggctggagagcagagccctggggttgccagccaagcctgtctcctctggaatggcccaggaccagggatggggcagcggcctgggaacccgagagtcaccagactggctgcaccgtgtgatctgatgcaaccacttccctctccgggccccagagtccctgcttatgaaattgggggtcgggggcagctggatgaggcagcccgggtcccttcctctcctagagagttaggatcctgtgatccctgggaggtggctatgactgtcagtcctacagacgaggaagctgaggctacgcacaggacagtgacttctccacagcacactagttgggcacagagaggaatgatggggctgagccccaccccacatgcccatgaagcttgtgagccttccagaaggcccatggaggaaaggcgtggagatgggaggtcgctgccctgggcaccccatcccagggtctaacccctttcttcaggtcctaggggccagctggggacctctcagaggagccctagacagtcaggcacctggcggctttgcaggcctggggtcactccttggctccagcccacagaaggcagagatggcagggcttcctgggcgtatagacagtaggccctgtaactgggctctgataacacccctccccttatcagtgggtcaaggactgggtggggtgcatctgagaatcaagggtacattccacagaaacaaggaaggggcagaaaggaaaagtgggtgcagctgaaccgaggcctctcagcccggctgcaaagaatcccggaggggtcccctggcttaggggggagagtgtggagtggtggggagtcaaaggaagggacagtctaagtctcacttaaccctccaggagccaaggggcctgatccaagtgactttcctgaagaaaccttagaaatcctaggctggggccgggcgccgtggcttatgcctgtattcccagccctttgggaggctgaggtgggcttatcacttgaacccaggagtttgagaccagcttggctaacatggtgaaactctgtctctactacaactacaaaaattagctggatatggtggtgcacacctgtaattccagctactcaggaagctgaggcacgagaatcagttgaatccaggaggaggaggctgcggtgagccgagatcgcaccactgcactccagcctgggcgacagagcaagactccgtctccaaaaaaaaaaaaagaaatcccaggctgggagggacagagagacctagaatccacatttagagcaggaggccattgccctcagagggttcatggtctcctttgacactatgaggaaaattatgtctgcccagtggggaaattgaggcccagcgtgtgaggggaaatgactcacagctggcttaaggcttgaaaggcccctgcctgaggctgagtgtgtcccctgcatacctggaggcgaggaccagtaggtgccgtcctgaactaagggacagggtggcagaggaaggtcagggcctccccagatactgggcctgggcttctttgcccctgtgggctgggactccaggcaggcaccacttcttcaaccagccagttccataattcacatcccggccttggcccaggctcctggaccccctcccccgtggcccatgccaggcaggtgggtgaggctgggcctgcacagggaagggtctgaagcctgcagggtcggttgtggcaggacccattgggctggagatctggagggacgtcctgcatcaccagcggtagagaggacaggggctgggccagcgtccccctgagaatgcgctcacaccccagcacacagacacacacacctccgcggcacctgggggtggctcatctgaacccttgggtgacatccttctgcccccaccctcctccacaccctggtttcacccggatacgaaggtggcaggaagcaaacagtgtgacttgggcccattttgacgctccaggtggcagaatcactggaacacctgataaaaattcccaccctcccctgacacggaaaggctgagccagaagagcctggcagaagggacttccctgaagaaaggggcccaggtcagtctcgaaggtggtccttggagaagctctgggtggtgtgtcagctgcgtggtggagaaaatcatcatgatgacactgaccgcgctcactgtgtgcctaccgtgtacctgtgtcccgatgttttgcatgaaacacctcattccggcctctgccagccttccagaaagatgcattattcccagtcccacggtcacattctggccgctagcagagccacagttagatgtgtccccccgacccccccaaccccaggggcctgaagacttgtggggcctgggaccaccccaggggcaagaccagaaccagctcctgacctcccaccaggaaagagggaccagggtgagacacagctgcaggaaagatgcaaggctgggccgtggtggagaacgcccccacccctccacttccccaggacgcggcaggcaggagggggccactcccagcctcagggccccagaaatggtaaggccagccctaaccccaccccagaggctccagagaggcagggctggaccaggccaggcctggtgaatccctgggctgcgagcgccccctgcagccagacaaaggtgtggccgggcagaggccaggtgctccccaacctcggacaccccgacattggtggattttcctcttccatcatctccagccctagctgggagctaggccagtcaactgctgcaattattattattattattattgtctgttgttgttgttgccctttttttttttttgagacagagtctcactctgtcacccaggctggagtgcaatggtgtggtcttggctcactgcatcctccaactgccgggttcaagcaattctcctgcctcagcctccctagtagctgggactacaggcatgtaccaccaagcccagctagtttctgtattttttactagagacagggtttcactatgttggccaggctggtctcgaactcctgacctcaggtggcctccggcctcccaaagtgctgggattacaggcgtgagccaccacgcccagcctattgttgcccaattttaaggaggagagaaatgttaggtgtcttgtccaaggtcacagagccaggtggtgtcaggtcctgaactcaggcctccacagatcctgggtcctccatcccggaaggtctttgtcccggcccattagagcctcctccaagccctcacccaggacggacatgcgcagcgtgacagttgtaagaggcaggcaagagtatttaatgggcattgagggtcttggcagtcccaccaggggagtgggcaaagggcaaggcacagaaaggcttccactcagggctcaggaagtgggaggtaaggaggcaggttcaggaggcgggttcaggaggcgggttcggaggtgagctcaggtgctggtgctgtgggcatctccgggtgcacaggggcgagaggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccacagaatgtgctgcagaggccccggggcgcaggggttgcccagccccacggtggcctcctgatgctccacctccatgtctcacggggcttcgagtcaatgtttcctttaaataaaagagtctcccgccacccgcaccccctggccaaattataaaccacgagactcatctcagtcctgcgagtaggtgactggcctgaggcccatcagcacatgtagtgggggagtcatcctccatttgtctttgtgactccagggactcctgggtgtattctagaggcctgggccctgcttccaacgcccctccagtgtagaaccctcctccccccaagctcggagcgctccagcttcagggtcagccaaacctcaggggcctccccccacaccctcacaacctgcagacacccccctcccgacacgcacagacacccacgcacacacacgcttcttacctcctggagagctgcagcctcaccacgccccgggggtcccttccctgctttgtagggacccagaggttggggctggggggttgagagcagagggggacattggagggtgcagattcggcatggatgtccagtcaggccccaccactctctgcagctggacagcttcagccatgtacctggggagcagcaggccagatgcaggggccaccgtcctccctggtccggctcccctgcccgcctcagcttgggaagcacacggcccagggcttagctctgcaggaagctgaggccagcctcatccaggatgcagcagccctgtatgccatagtggggcaggaacacacagagccaaggacgtagggaggccccagagctcccagtgccctggagaaaaccccagaggagcaggaacagtgagtgtaagggcctggggctgtggtaaggagccagggtgaacccacctctgccccacccccagggttcaccagttgggcctctggcttgccaactcacttgggtcccagtggtgcacaaattgttaaataccagttgctggcacagccctggtcgaaggggttgtatccctgaaggtgtctgcactggtcggggatggaaaccggaagaggagctcagaaccagcaggaatggctgggccatcgcccagtggccctccctgagctggtcagctagccagggctcagcccagggcaccagcaagctggaggccaggagactgaaggacctccccaccactgccccatcctcctcctcttggtctccactggccacacacatcctcctgctacctccttccagatactgaatgtcactgtctggaaggtcagttgagcaaggcccagtcgtatttccctaaccatgatcacatggcccaggaaaatctgggctaaaagccttgaacacgcaatgcggtaaaggccaagtcgtcccctgggcactcttgaccttgatcaggttctctccctcctctctccccttcgcccactcactctacccatccacctcaccccctcccaaactccctctccgccacagggcaggctgggcctcacctgacttcaagagcctttgctgtcatgttttgtcactgaaagtggcccagcagcatctctgcccaccaccaactcccctgtgtcccatgtccccgctctccgccgcaaaggctgagattttcaacaccattctccaccaaaggaaccaggactccatgcaaggacagctggcactcactggagggaggaaaagtctggacagctccataacagctcactgtcgccactcactgttgccatagggcaatacgcatccttgcactatttgagattctgcctactttaaggtatttaaagcatgtaaaagaaacgtattggccgggtgagatggctcacgcctgtaatccctgcactttgggaggccgaggcaggtggatcacttgaggtcaggagtttgagaccagcctggccaacatggtgaaaccccatctctactaaaaatacaaaaaattagccaggcgtggtggcgggtgcctgtgatcccagctactcgggaggctgagacagaagaatcgcttgaacccgggaggcggaggttgcagtgagccgagatcatgccactgcactccagcctgggcgacagagcgacactctggctcagaaaaaagaaactggtattgtattagtcatttagaagattttgattaaatttatggaatttgggccaggcatggtgattggcacctgtaatccgagtgttttgggaggtggagaagggaggatctcttgaccccagaagttcaagaccagcctgagactttcatctctaaaaaaataaaaataggtggctgtggcattgtgcacctgtagtctcagcttcttgggaggctgggatgagaggatcccttgagcctaggagttcgaggctgcagtgagctatgattacgccactgcactccagcctgaatgacagagtgggaccctgtctctagaaaaactaaaatctaataaaaatatattgacagaattttaaaatttagggatatatatatatatatgtatatatatatataatttttttttttttgagatggagtcttgctctgtcacccaggctggagtgcagtggcgcgatctcagctcactgcaagctccgcctcccaggttcacgccattctcctgcctcagcctcccaagtagctgggattacaggtgctcgccaccacgcccagctaattttttgtatttttagtagagacggggtttcaccgtgttagccaggatggtctcgatctcctgacctcgtgatccgcccaccttggcctcccaaagtgctgggattacaagcgtgagccaccacgcctggccttttttttttttttttttagacgcagttttgctcttgttgcccaggctggagtgcagtgatcataggtcctcacaaattcaaactcctgggctcaagggatcctcccacctctgtctcccaagtagctgagactacaggcatgcaccactatgcccagccaatttttaattttttttgcaggaatggggtctggctatgttgcccaggctggtcttgaactcctggcctcaagcgatcttcccacctcagcctttcaaagggctgggattacaggtgtgagtcactgtacccggcattagggaaataaatttttatttattagatgtatataaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaaggaaagaaggcccagtgtgacatcacagaggctgggggacctcagcagaactgtctgcagccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttggtaattttcagccggcgctgtaatccctgtaatcccagcactgtgggagaccgaggcaggcagatcactcgaggtcaggagttcgagaccagcctggccaacatggtgaaaccccatctccactaaacatacaaaactagccaggagtggtggtgcacgcctgtagtcccagctactcagaaggctgaggcaggagaatcacttgaacctggaaggtggacgttgcagcgagccaagatcgcgccattgcactccaacctgggtggcagagtaaactccatctcaaaaaaaaaaaaaaaaaaagaaagaaagttgctgggtttttttgttggtttgttttgtttgtttgtttgtttttgagatagtttcgctcttgttgcccaggctggagtgtaatggcgcaatctcggctcactgcaacctctgcctcctgggttcaagcggttctcctgcctcagcctcccaagtagctgggattacaggcatgcatcaccatgcccggctcattttgtattttgtagtagagacggggtttagtcatgttggccaggctggtctcgaactcctgaccacaggtgatccacccacctcagcctcctaaagtgctgggattacaagcatgagccatattaaacttcctttataaaaggcctcaaaaagaagaaactgaggcagaaatttaaaaataaatatgcattcattcactccaagacaagtaacaagcaaggcaaaagttaaaaagaaaagaacaagttttcctctgcccagcaagctcacttcaaggacagttataagataacgctgtttaagaggccaaggccaaaagaataagctccagacacccctcgcctccagagcaaagttgaagaaaaaaaagaaagacaaattctttgactgttactcctttcccaggtttcttaagcatgattatgttttacaaatgtctgtatttagccagttcttgtttttctttcaatgcagctacaaagtcaccagctatgcaaggccacaagttatgctatagatgatgtgacctgtcatatgattaactacttttatttattggaagtctgcttataaaaaccccgctctgtctttgttcgatgctcagctttttagatgacagtccactaagccagtgcgtacctgaaataaacagtcctctcgttctctgtctcagtcttgccagtcctcagtttcctgcaacatctctactaaaaatacaaaaattagccaggtgtggtggtgcgcacctgtaatcccagctactcgggagcctgaggcacgagaatcgcttgaacctgggaggcggaggttgcagtgagccgagatctcaccattgcactccagcctgggaaacaagagtgaaactatgtctcaaaaacacagaataaaagaaaagaaaagattatgcaaaatggaagaaactaggcacaaaaagccacatattgtatggttccacttacatgaaatatccagagtagccaaatccatagagatcaaaagcagattcacagttgccagggtgtgggaggagggggactggaagagatgaggtttgttgttgttgttttgagactgagtctcactctgtcgcccgggctggagtgcaatggcaccatctcagctcactgcaatctctgcctcccgggttcaagcaattctcttgcctcagcctcccaagtagctaggattataggcacctgccaccatgcccagctaattttttttttgtagttttagtagagacggagtttcaccatgttggccagcctggtctcgaactcctgacctcaggtgatccacccacctcagcctcccaaagtacgggcattacaggagtgagccactgcactcggcctaatttttgtatttttaagagatggggtttcaccatgttggtcaggctggtctcgaattcctgacctcaagtgagccacctgcctcggcctcacaaagtgctgggattacaggtgtgagccacggcgcccagcctcttttttgatttttcaaaactgactctcatattaaggaagccaaaacttaagtgataactgaaatgatcgtgttactgaccacaggttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtaggtgagcgtccctgcaggagtgacagaacgcacagggatagttaggaatcgcggtaacacatacatcgcaggatcagaacacgacgagaaagcctctccctggcagaggcttttgttttgtttctgtctgtcacccagtctggagtgcagtgacaagatctcggctccctgcaacctccgcctcccaggttcaagcgattctcgtgcctcagcctcccgagtagctgggattacaccaccacacctggctaatttttgtatttttagtagagacggggtttcaccttgttggccaggctggtctcaaactcctgacacctcaggtgatccgtccgcttcggcctcccaaagtgctgggattccaggtgagagctgccgcgccgaggcagaggtcttggtcttgtaatgaggccgagggtaaagagtggtcgtgcttccggcttcctgcacacaaaggcaatggagttcattccctgaagtacaagattggaagtgcgacgctgcctatcttcatttttcaaggtcgtgtgatcagtggatgtggcattttgtgtaagatttacagtggaatgctgcttatcttaatgctttcactgtccttcaatgagcaggtaagaaaaaaaaaggaagaaagaaaaatgttgggggggggaatgcattagcgaatgcattagtggagttggcagccgagtcccatccctcctctgtctcaataagtgtcagatgatgctatcatataattttgtgggaaaaaataggccaaagaaatgaaattcagaaggacttattctttttggttctaaaatcagtttctgagagctggcaggccccaactgccaagaggagaccctggcggccacagctcatcctctctgaccaagccttagctggggatgggccggcctccaggcagggcctcccgctggctggatcccgggccacactgtacagaagacaaccccgtagagaccttgggtggggcagaagcccccttccctcactgacaccctgccggtctctcctggggtctcccagtctctgctgcccagtggggaagcacccgtctcagcccaaccgcagccccccccggctccctcctgccctttcacctttcctgccattccccactgtgtcctgaagtttctaagaacatccccagcgccctgttgtcagctctgggaagtctaaagttcagggctttgggtaattaaacccaaggcctctcagtgggctgggggtgaatgacctggcgaacgtgcctgcggagatgctgggaggaagctgagtcagtctgcgtctttgtcagggtgggctgaggccagtgaccctctgggggtcagggcccttgcaggcctcttccttccctgacctccaccttaggaggcagctggcccctgagacgcctgcctcacgacattgtcctgtcccaggaactggactttaggaggaggggaagctggagggggatgcagcttgactcttgggagagactttgaggtgtctgggcacaggagtggggagtcctccgggtaccccatcagggactgcttccactgcttgtatggcctcaccagcccagcgcaggaagccccctctcccttcccagaattgaccctctgcaccctctcctgggccctcttctcactacctccatctccaccatgccccaacagagcccctcccccaggcccctttggccgctctccacaccccacagctttctgtctgacctggtttcttagcctctctggacctcagcctccttatctgtaaaatgggaataaggatactacttcccttgtaacgcggtggtaaagtttaaataagctaaggaacacactgcatgtcctgcgggccctggcacaccagacatgctgacagacgctggctgctttcatcagctatgcaaccaaattctaaggggcccttcgtatgtgtcaggctgcgtgccaggaacctagaggtaccaccgtaccacagtacaagatgctgtgtctggcttcgaagagatttcagtctatgtggagagagagaaaagggaagctatcagccaataaaatcgtttgcaagcctgtaattcagcaggttttcaagacctgtcaaatgcccagcaatctcactctgcaactctgcctcttaaatacagcatcttccggcccagcgtgggggtggctaagcccatcatccagatgtgatgaactggggtctgggaaacccacaccggcctcatctggcttttccagcctgtcctcccttccacacatcaggctgacagcaccaaacacggccgaggcctcagccctgagtctccccgctgcagagtgcccaagcctgagttccagcaggttcttcaggggccgctgaccagggaacactgcggtgaggagcgaggacttcgtccccaccccggcccagggcaggggcttcgtggtgagcccaccccaccccagaaggctcctggaagggcagggcagactggcagcaaaatcctataggatgggccgggccagaggcaaggggtggccaaaggcacctgtccaagaggtgggagggaccacacctgggggcagggacgagtcaggcacagggaactccgccagcctagaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaagagtatatagtattgtgtctggcataagaaaaggagaacttggtgaggtgaaatagcaccagcccagagtcttgaagaagccaggggccctggagaacagatggaaggtgacctttccctgacaggtgtgctactacggcaccaaccacgcggggccctggtggtctgggtcagcctcactttgtgggacaatggcttttgagtcttcagtgacaagctagaaaaggaatctcctgacactgtggtcatggagcttgatttctaaggagagagtcagcacgtggaagcaaaggcaccgagagtccaagtaaaagtcccaaatccataaaatgcaccacacaggtcaaaacacaggacacggccgggcgcgggggctcacgcctgtaatcccagcactttgggaggccgaggcaggtggctcacctgaggtcaggaattcgagaccagcctgctcaacatggagaaaccccatctctactaaaaacactaattagccaggcgtggtggcgcatgcctgtaatcccagctacttggcaggctgaagcaggagaatcgcttgaacctgggaggcggaggctgcagtgagccgagattgcgccactgcactccagcctgggcaagaagagcaaaactccgtctcaaaaaaaataaaaataaaaaataaaaacaccactggacatggaacatcaggtaaaaccacactgcctttatttggctaaagaacaaaatccaaaataactcagaacaaactaagaacagacaggaaaattacagactgaaccccacttgaggaagacttccccacggactcacactggtgatggggcgaacgttcaagacgaagccagcagtcctttccaagactcttttgtcttttagggatcctcaatacaaaacaacccaactaatccaggatatgtgttcaaaacagtcagttttccccctcaaaaggcgggaaggcccacttcaaacctccaggaacacaacccaagtcatcccagtgttaaacctggtgcttccgttttctgcctcaatccgagcgctaacataaaatcttggcagacaacaatctttcttcttcaagaaaattaacatttaatggtataatcccaagaacatgttctacttatttacttggaaaaatagaagctagggaccactctttatccgatggcagtctattctatgagagaaaacaagaacaatcattgttatgactttgaaaaatagaacctttaaaaatacttatattggtaagcttaaaaaaatatcatcagttaaaaacattaagggggctttctttttctacctgtattggttcaacttctggtgagaatgtgtgctgatagaaaatctagaagctatggcttttagggaattaaagaaaagcagcaaaatataattgatttggaaagattttggataagtgatctggaacaggattaaaaaggcaaagagctcttgaaaataagctacccatagtcaaaataatccaggaagggggaatgacgccctatgaaccactgtggaaagaacatctagagatggtctgaccagctgtgcagcctccaaaaaaaaatcactatcgctcaggtgcagccccccaaaaaccaccatcactcaggtacagcctccaaaaacaccaccatcactcaggtgcagcctaaggagtcatcagtgatcagaaagtggctaagtttccttagcctccctcatattttttctcttcttcaggattttcaacctcctcacatccctaactttcttacccaagcctcagcaatataatggtctttggctctagctatcagcaatagctgcaagagcacaaatgatcccttcctagtcctctaaagtgtcaacctccattcttcagtgcttctgaatctagcataagaccaagctttccgtccggcccaccggaaggcagtggctgcgccggcacctccccggctctggccttctaatgtctcacacacagaggctctgctctaaggccaacacttctggctctctcatcttggccacatttggcccacccatgttgactgctttctcgtgtgtgattcagggaaacagctccatagcctcaaacgttaatatctgaagatttagatcccaggcattgtggtggtgtgcacacctctaacctcatttaattaggcacagatgaccacattatgcaacttcccaacagctttctccatctacccgtgctagtccagcacctcagaccacatttaccccaaagtatctaacaggccacactataaaagattttagctttcagtcagacaaatagctttcagtcaaaacgattagactgaggtggtagaagctcaccaaaaggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgccacaccacaccagggagaataagttagacagaaacaggcagcattcccaaagagagaaggctgacgcagaaaagttcaaagatgagactatgtaacactgggtaacacaggaaaacactaacttcagctgtttcaaagacagacaggattccaagccaaagcttgtatgaccagatttaagagtaagaactgcgcttcaaagaagagttagaaatgtcgttgtcataggcgatcaggataacaagaggcttcattctccctcgcctctgtgacgctctttctgggtgatccaagttttgttttttttctagttgattatttctctttatttctgtatgtgtgtgtggtttttgttttgttttggagacagagtctcgctctgtcacccaggctggactgcagcggcaccatctctgctcactgcaacctccgcctcctgggttcaagggattctcctgcctcagcctcccaagtagctgggattacaggtgcccaccaccacgcctggctaatttttgtatttttagtagagatggggtttcaccacgttggtcaggctggtctcaaactcgtggcctcaagtgatccaccagcctcagtctcccaaagtgctgagatgacaggcgtgagccaccacgccttgcctgggtgatccaagttttaagaaccaaggtagtcctgctgtgcaggcaatgattctagcctctgaccctcaggcggaaaactaggtgttaccagaaagtgtttagggagtggactatgagatgctcacagtcctagcagaggcaaggaaagagaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatccccccgggcaagccaacaaggcagatggaaccacaaccaccaggcgtgtgtgaaaagtggggagaaaacctaccacactcttgtcacgtgagggtatgctctgtggcttgctggaggagcagcagagggaggtccctgccagctgcagctctcagaggaaaagaaagatgtggagcactggttccagggaagaatgttctgaagagggacagaggtcaaggtgataaggctgttgctttagaaaggaaggtgtttcctatgcttttgcctttacattctgtgcaaatctctctaatatggctatgaccaaaatggattaacatcaagttccaacagcagacatttacaaagtatcctttgtaaaaggctaggtaatattaatagcattcaaataggagtagcagggccaggcacttactcccagtaggaaactaatctcaatcgacttggtataggattgagtattgtcccgctcctctcctcatcattgtaactctaaaagtgttccttccttcgaaggtagatggcacgaaagagactgacaaaagctcccaaagaactgggtcacagagttttctgagaagatgaacacagcagaaacactgcagttgatgccatgggtctgcttccatccccatcagtgtcttcatggaccccattgggtccaacaagaaactcctcagggagtaagaaaagttaggttcagatctccttcccgcagccacaatgacactggtgacagcagtacgttcaggggatttgtgactgtaactctgcttttcgcttttccttaaggaaatcaaaattaagatatttctccacaaattacccatcagcgtggctcatttcgtgaaggacttggcaagccacatagcttcagaacggaaggcaaatgctatagtataccgggaagaaaaggcctctgcgtattacactacctccttcttctgcccactcctcaggggcaaaaaattagttctacatttgaaagacgaattttttaaaaaattaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggggaaggcagctgatggaagagccagccggaagttccgcctacttcccctacctctgtcaatccgaccacgacttctccttgaaaaccacgactcctgacacagtagttccgcctcctcagaggcccccgggatgaagtgacccagcagaaataccagagaccggagacggaatggcccagggtcagcctccacccggaaccggaggatgcagcgaagacgtctccttgaagtgggatacggatgtgaaccggcccaagtgctcgccggtccgtcaagacgcgctgcccggctgctcccgtgtccaactcgggctgtgtccgcccaggcgggcctgtgcgcggaggtcctaccgctgcacctccgcgcctaccgcagcccgcacccccgcacccgggcagccaacgtgcaggaggcccgggcgccttcagcggagacgccccgaccgcggctgcctcgccgcagcgttagcttttacctacgtggggaagtaaggggaatttgcgaccgccagcccagtccgctgaaaacctgtggctgacccaccctcttcctttttctgacccacgttggctccaaaaaaaaaaatccctagggatccactgggagccagttgagcaggagtggattaagacacgtgtcgcagggtgtatggtggaaagaaacgttttcctttgctagaatgaaccttgggaaggatcccttttgattccgtagatgtaagaggctacacaatattatggaagaaggatgtaaaaaaaatgtattattattttttagttaccaactggactgaagtaaaagaccttttaaacttatttacttattcttttatttttttaaaagacggagcctcgctctgtcgcccgggctggagtgcagtggcgcgatctcagctcactgcagcctccgcctccagggttcaagggattctcgtgcctcatcccgagtagctgggattacaggcatgcgccaccacgcccggctaatttttgtatttttagtagagtcggggtttcaccatgatggtcaggctggtctcgaactcgtgacctcaagtgatctgcccgcctcagcctcccgaagtgttgggatcacaggccaccgcgcccagtcaactttttgttgctattgttgttgctttgctttttttattttattttgctttttttgtctacatcaagggtatccaatcttttggcttccctggggcacattggtagaagaggaattgtcttgggccacacataaagtacactaacagtaacaatagctgatgacttaaaaaaaaaaatcgcaaaaaaaaaaaaaacctcatgtgttttagaagtttacaaatgtgtgttgggccgcatgcaaagctgttctgggccgcggcttggacaagcttggtctacatgcttaacttgaaagtggctgagaagaaagaggatgggtataactgcatctgctgaggagtttccagggggaaaaaggatttaaacctgaatttcaaatatgtctttgaacatggcggttagactaaggtaccccaaataaggacagttagctggagaagacaccgcggcctctaaggggaacatcactacaaaaatagagttgagatagtaaccaacatcagaatctcagtcttaagggaggatgaatttcataagaccctgacactgtggacaaagaaaatggatgggtgtttaggctaataagctatgtaagacataggatggcaagagctgagcaaaaacactgtgtgagaaagatgaaggcaacaattcaaaatgtaggaaaaagcagccaggcatggtgtttcatgcctgtactcccagcatattgggaggctaaagcaggaggatcacttgaggccaggagttcaacactagcctgggcaacatagcaaggcctcatctctataaaaaataaaattactgttgggagggcaacatgggcggatcacaaggtcaggagttcgagaccagcctggccaacatggtgaaaccctgcctctactaaaaatacaaaattagccaggcgtgggggcgcatgcctgtaatcccagctacttgggaggctgaggcaggagaatctcttgaacctgggaggctgaggtttcagtgagccaagatggcgccactgcactccagcctgggtgacaaagcaagactctgtctcaaaaactaaataaataaaataaaattactggccaggtgtggtggctcacacctgtaattccagcactttgggaggccaaggcaggcagatcacttgaagccacaagtttgagaccagcctggccaatgtggcaaaaccccatctgtacaaaaaaaaatacaaaaattaggtgggcatggtggtgcctgcttgtaatcccagctactcgggaggcaggagaatctcttgaacccagaaggcagaggttagtgagccgagatcgtaccactgcactccagcctgggcaacagagcaacactctgtctcaataaataaaaaaataaaaataaacattttttaaaaatagccatgtgtgttggcatgcctgtagtcccagctactcaggaggctgaggtggcaggatcacttgagcctaagagttcaaggctgcagcaagttacagtcccgctactgtgccccagcctgggcaacagaacaaggcccattctctgaaaataaaaataaataaattcaaaagttattttaaagatgtaggaaaaagctttatgcacaaataaagccatgtctttattttttataatagtgaaaaatcagaaataagcagaccctcaataaggaactggcaaaaataacaatatggtataacctattgaaataaatgccgctattaagtcatgcatcttaaaatcataatgcaaataaaatgacataaaaactgttcataacatcatgagaaatgaaaaatgagggtacaaaattatatgttttttaaaccttggaaataaaaaacattggtagaaaatataccaaaatttttaccattggttatgtttgaacaattgaaatggcttttcccctacttttttctctgtgttccagtgtaacaagaatatagtagggccgggcgcagtagttcacacctgtaatcccaacactttgggaggctgaaatggatggatcatgaggtcaggagtttgagaccagtctggccaatatggtgaaaccccgtctctagtaaaaatacaaaaattagccaagcgtggtggcacttgcctgtagtcccagctacttgggaggctgaggcagaagaatcacttgaacccaagaggcggaggttgcagtgggccgagattgtgccactgcactccagcctgggcgacagagagagactctgtctcaaaaaaaaaaagaaagaaagagagaaagagagagagagggagagagagagagagacagagagagagagaggaaggaaggaaagaaagaaggaaggaaagaaagaaacagaacatagtgtaacaaaatcaaaacattaaaaatataaggcctaaaacacaacagattcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtat

SEQ ID NO: 759 - DNA, 565648 bp, Homo sapiens
aaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaaggaaagaaggcccagtgtgacatcacagaggctgggggacctcagcagaactgtctgcagccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttggtaattttcagccggcgctgtaatccctgtaatcccagcactgtgggagaccgaggcaggcagatcactcgaggtcaggagttcgagaccagcctggccaacatggtgaaaccccatctccactaaacatacaaaactagccaggagtggtggtgcacgcctgtagtcccagctactcagaaggctgaggcaggagaatcacttgaacctggaaggtggacgttgcagcgagccaagatcgcgccattgcactccaacctgggtggcagagtaaactccatctcaaaaaaaaaaaaaaaaaaagaaagaaagttgctgggtttttttgttggtttgttttgtttgtttgtttgtttttgagatagtttcgctcttgttgcccaggctggagtgtaatggcgcaatctcggctcactgcaacctctgcctcctgggttcaagcggttctcctgcctcagcctcccaagtagctgggattacaggcatgcatcaccatgcccggctcattttgtattttgtagtagagacggggtttagtcatgttggccaggctggtctcgaactcctgaccacaggtgatccacccacctcagcctcctaaagtgctgggattacaagcatgagccatattaaacttcctttataaaaggcctcaaaaagaagaaactgaggcagaaatttaaaaataaatatgcattcattcactccaagacaagtaacaagcaaggcaaaagttaaaaagaaaagaacaagttttcctctgcccagcaagctcacttcaaggacagttataagataacgctgtttaagaggccaaggccaaaagaataagctccagacacccctcgcctccagagcaaagttgaagaaaaaaaagaaagacaaattctttgactgttactcctttcccaggtttcttaagcatgattatgttttacaaatgtctgtatttagccagttcttgtttttctttcaatgcagctacaaagtcaccagctatgcaaggccacaagttatgctatagatgatgtgacctgtcatatgattaactacttttatttattggaagtctgcttataaaaaccccgctctgtctttgttcgatgctcagctttttagatgacagtccactaagccagtgcgtacctgaaataaacagtcctctcgttctctgtctcagtcttgccagtcctcagtttcctgcaacatctctactaaaaatacaaaaattagccaggtgtggtggtgcgcacctgtaatcccagctactcgggagcctgaggcacgagaatcgcttgaacctgggaggcggaggttgcagtgagccgagatctcaccattgcactccagcctgggaaacaagagtgaaactatgtctcaaaaacacagaataaaagaaaagaaaagattatgcaaaatggaagaaactaggcacaaaaagccacatattgtatggttccacttacatgaaatatccagagtagccaaatccatagagatcaaaagcagattcacagttgccagggtgtgggaggagggggactggaagagatgaggtttgttgttgttgttttgagactgagtctcactctgtcgcccgggctggagtgcaatggcaccatctcagctcactgcaatctctgcctcccgggttcaagcaattctcttgcctcagcctcccaagtagctaggattataggcacctgccaccatgcccagctaattttttttttgtagttttagtagagacggagtttcaccatgttggccagcctggtctcgaactcctgacctcaggtgatccacccacctcagcctcccaaagtacgggcattacaggagtgagccactgcactcggcctaatttttgtatttttaagagatggggtttcaccatgttggtcaggctggtctcgaattcctgacctcaagtgagccacctgcctcggcctcacaaagtgctgggattacaggtgtgagccacggcgcccagcctcttttttgatttttcaaaactgactctcatattaaggaagccaaaacttaagtgataactgaaatgatcgtgttactgaccacaggttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtaggtgagcgtccctgcaggagtgacagaacgcacagggatagttaggaatcgcggtaacacatacatcgcaggatcagaacacgacgagaaagcctctccctggcagaggcttttgttttgtttctgtctgtcacccagtctggagtgcagtgacaagatctcggctccctgcaacctccgcctcccaggttcaagcgattctcgtgcctcagcctcccgagtagctgggattacaccaccacacctggctaatttttgtatttttagtagagacggggtttcaccttgttggccaggctggtctcaaactcctgacacctcaggtgatccgtccgcttcggcctcccaaagtgctgggattccaggtgagagctgccgcgccgaggcagaggtcttggtcttgtaatgaggccgagggtaaagagtggtcgtgcttccggcttcctgcacacaaaggcaatggagttcattccctgaagtacaagattggaagtgcgacgctgcctatcttcatttttcaaggtcgtgtgatcagtggatgtggcattttgtgtaagatttacagtggaatgctgcttatcttaatgctttcactgtccttcaatgagcaggtaagaaaaaaaaaggaagaaagaaaaatgttgggggggggaatgcattagcgaatgcattagtggagttggcagccgagtcccatccctcctctgtctcaataagtgtcagatgatgctatcatataattttgtgggaaaaaataggccaaagaaatgaaattcagaaggacttattctttttggttctaaaatcagtttctgagagctggcaggccccaactgccaagaggagaccctggcggccacagctcatcctctctgaccaagccttagctggggatgggccggcctccaggcagggcctcccgctggctggatcccgggccacactgtacagaagacaaccccgtagagaccttgggtggggcagaagcccccttccctcactgacaccctgccggtctctcctggggtctcccagtctctgctgcccagtggggaagcacccgtctcagcccaaccgcagccccccccggctccctcctgccctttcacctttcctgccattccccactgtgtcctgaagtttctaagaacatccccagcgccctgttgtcagctctgggaagtctaaagttcagggctttgggtaattaaacccaaggcctctcagtgggctgggggtgaatgacctggcgaacgtgcctgcggagatgctgggaggaagctgagtcagtctgcgtctttgtcagggtgggctgaggccagtgaccctctgggggtcagggcccttgcaggcctcttccttccctgacctccaccttaggaggcagctggcccctgagacgcctgcctcacgacattgtcctgtcccaggaactggactttaggaggaggggaagctggagggggatgcagcttgactcttgggagagactttgaggtgtctgggcacaggagtggggagtcctccgggtaccccatcagggactgcttccactgcttgtatggcctcaccagcccagcgcaggaagccccctctcccttcccagaattgaccctctgcaccctctcctgggccctcttctcactacctccatctccaccatgccccaacagagcccctcccccaggcccctttggccgctctccacaccccacagctttctgtctgacctggtttcttagcctctctggacctcagcctccttatctgtaaaatgggaataaggatactacttcccttgtaacgcggtggtaaagtttaaataagctaaggaacacactgcatgtcctgcgggccctggcacaccagacatgctgacagacgctggctgctttcatcagctatgcaaccaaattctaaggggcccttcgtatgtgtcaggctgcgtgccaggaacctagaggtaccaccgtaccacagtacaagatgctgtgtctggcttcgaagagatttcagtctatgtggagagagagaaaagggaagctatcagccaataaaatcgtttgcaagcctgtaattcagcaggttttcaagacctgtcaaatgcccagcaatctcactctgcaactctgcctcttaaatacagcatcttccggcccagcgtgggggtggctaagcccatcatccagatgtgatgaactggggtctgggaaacccacaccggcctcatctggcttttccagcctgtcctcccttccacacatcaggctgacagcaccaaacacggccgaggcctcagccctgagtctccccgctgcagagtgcccaagcctgagttccagcaggttcttcaggggccgctgaccagggaacactgcggtgaggagcgaggacttcgtccccaccccggcccagggcaggggcttcgtggtgagcccaccccaccccagaaggctcctggaagggcagggcagactggcagcaaaatcctataggatgggccgggccagaggcaaggggtggccaaaggcacctgtccaagaggtgggagggaccacacctgggggcagggacgagtcaggcacagggaactccgccagcctagaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaagagtatatagtattgtgtctggcataagaaaaggagaacttggtgaggtgaaatagcaccagcccagagtcttgaagaagccaggggccctggagaacagatggaaggtgacctttccctgacaggtgtgctactacggcaccaaccacgcggggccctggtggtctgggtcagcctcactttgtgggacaatggcttttgagtcttcagtgacaagctagaaaaggaatctcctgacactgtggtcatggagcttgatttctaaggagagagtcagcacgtggaagcaaaggcaccgagagtccaagtaaaagtcccaaatccataaaatgcaccacacaggtcaaaacacaggacacggccgggcgcgggggctcacgcctgtaatcccagcactttgggaggccgaggcaggtggctcacctgaggtcaggaattcgagaccagcctgctcaacatggagaaaccccatctctactaaaaacactaattagccaggcgtggtggcgcatgcctgtaatcccagctacttggcaggctgaagcaggagaatcgcttgaacctgggaggcggaggctgcagtgagccgagattgcgccactgcactccagcctgggcaagaagagcaaaactccgtctcaaaaaaaataaaaataaaaaataaaaacaccactggacatggaacatcaggtaaaaccacactgcctttatttggctaaagaacaaaatccaaaataactcagaacaaactaagaacagacaggaaaattacagactgaaccccacttgaggaagacttccccacggactcacactggtgatggggcgaacgttcaagacgaagccagcagtcctttccaagactcttttgtcttttagggatcctcaatacaaaacaacccaactaatccaggatatgtgttcaaaacagtcagttttccccctcaaaaggcgggaaggcccacttcaaacctccaggaacacaacccaagtcatcccagtgttaaacctggtgcttccgttttctgcctcaatccgagcgctaacataaaatcttggcagacaacaatctttcttcttcaagaaaattaacatttaatggtataatcccaagaacatgttctacttatttacttggaaaaatagaagctagggaccactctttatccgatggcagtctattctatgagagaaaacaagaacaatcattgttatgactttgaaaaatagaacctttaaaaatacttatattggtaagcttaaaaaaatatcatcagttaaaaacattaagggggctttctttttctacctgtattggttcaacttctggtgagaatgtgtgctgatagaaaatctagaagctatggcttttagggaattaaagaaaagcagcaaaatataattgatttggaaagattttggataagtgatctggaacaggattaaaaaggcaaagagctcttgaaaataagctacccatagtcaaaataatccaggaagggggaatgacgccctatgaaccactgtggaaagaacatctagagatggtctgaccagctgtgcagcctccaaaaaaaaatcactatcgctcaggtgcagccccccaaaaaccaccatcactcaggtacagcctccaaaaacaccaccatcactcaggtgcagcctaaggagtcatcagtgatcagaaagtggctaagtttccttagcctccctcatattttttctcttcttcaggattttcaacctcctcacatccctaactttcttacccaagcctcagcaatataatggtctttggctctagctatcagcaatagctgcaagagcacaaatgatcccttcctagtcctctaaagtgtcaacctccattcttcagtgcttctgaatctagcataagaccaagctttccgtccggcccaccggaaggcagtggctgcgccggcacctccccggctctggccttctaatgtctcacacacagaggctctgctctaaggccaacacttctggctctctcatcttggccacatttggcccacccatgttgactgctttctcgtgtgtgattcagggaaacagctccatagcctcaaacgttaatatctgaagatttagatcccaggcattgtggtggtgtgcacacctctaacctcatttaattaggcacagatgaccacattatgcaacttcccaacagctttctccatctacccgtgctagtccagcacctcagaccacatttaccccaaagtatctaacaggccacactataaaagattttagctttcagtcagacaaatagctttcagtcaaaacgattagactgaggtggtagaagctcaccaaaaggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgccacaccacaccagggagaataagttagacagaaacaggcagcattcccaaagagagaaggctgacgcagaaaagttcaaagatgagactatgtaacactgggtaacacaggaaaacactaacttcagctgtttcaaagacagacaggattccaagccaaagcttgtatgaccagatttaagagtaagaactgcgcttcaaagaagagttagaaatgtcgttgtcataggcgatcaggataacaagaggcttcattctccctcgcctctgtgacgctctttctgggtgatccaagttttgttttttttctagttgattatttctctttatttctgtatgtgtgtgtggtttttgttttgttttggagacagagtctcgctctgtcacccaggctggactgcagcggcaccatctctgctcactgcaacctccgcctcctgggttcaagggattctcctgcctcagcctcccaagtagctgggattacaggtgcccaccaccacgcctggctaatttttgtatttttagtagagatggggtttcaccacgttggtcaggctggtctcaaactcgtggcctcaagtgatccaccagcctcagtctcccaaagtgctgagatgacaggcgtgagccaccacgccttgcctgggtgatccaagttttaagaaccaaggtagtcctgctgtgcaggcaatgattctagcctctgaccctcaggcggaaaactaggtgttaccagaaagtgtttagggagtggactatgagatgctcacagtcctagcagaggcaaggaaagagaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatccccccgggcaagccaacaaggcagatggaaccacaaccaccaggcgtgtgtgaaaagtggggagaaaacctaccacactcttgtcacgtgagggtatgctctgtggcttgctggaggagcagcagagggaggtccctgccagctgcagctctcagaggaaaagaaagatgtggagcactggttccagggaagaatgttctgaagagggacagaggtcaaggtgataaggctgttgctttagaaaggaaggtgtttcctatgcttttgcctttacattctgtgcaaatctctctaatatggctatgaccaaaatggattaacatcaagttccaacagcagacatttacaaagtatcctttgtaaaaggctaggtaatattaatagcattcaaataggagtagcagggccaggcacttactcccagtaggaaactaatctcaatcgacttggtataggattgagtattgtcccgctcctctcctcatcattgtaactctaaaagtgttccttccttcgaaggtagatggcacgaaagagactgacaaaagctcccaaagaactgggtcacagagttttctgagaagatgaacacagcagaaacactgcagttgatgccatgggtctgcttccatccccatcagtgtcttcatggaccccattgggtccaacaagaaactcctcagggagtaagaaaagttaggttcagatctccttcccgcagccacaatgacactggtgacagcagtacgttcaggggatttgtgactgtaactctgcttttcgcttttccttaaggaaatcaaaattaagatatttctccacaaattacccatcagcgtggctcatttcgtgaaggacttggcaagccacatagcttcagaacggaaggcaaatgctatagtataccgggaagaaaaggcctctgcgtattacactacctccttcttctgcccactcctcaggggcaaaaaattagttctacatttgaaagacgaattttttaaaaaattaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggggaaggcagctgatggaagagccagccggaagttccgcctacttcccctacctctgtcaatccgaccacgacttctccttgaaaaccacgactcctgacacagtagttccgcctcctcagaggcccccgggatgaagtgacccagcagaaataccagagaccggagacggaatggcccagggtcagcctccacccggaaccggaggatgcagcgaagacgtctccttgaagtgggatacggatgtgaaccggcccaagtgctcgccggtccgtcaagacgcgctgcccggctgctcccgtgtccaactcgggctgtgtccgcccaggcgggcctgtgcgcggaggtcctaccgctgcacctccgcgcctaccgcagcccgcacccccgcacccgggcagccaacgtgcaggaggcccgggcgccttcagcggagacgccccgaccgcggctgcctcgccgcagcgttagcttttacctacgtggggaagtaaggggaatttgcgaccgccagcccagtccgctgaaaacctgtggctgacccaccctcttcctttttctgacccacgttggctccaaaaaaaaaaatccctagggatccactgggagccagttgagcaggagtggattaagacacgtgtcgcagggtgtatggtggaaagaaacgttttcctttgctagaatgaaccttgggaaggatcccttttgattccgtagatgtaagaggctacacaatattatggaagaaggatgtaaaaaaaatgtattattattttttagttaccaactggactgaagtaaaagaccttttaaacttatttacttattcttttatttttttaaaagacggagcctcgctctgtcgcccgggctggagtgcagtggcgcgatctcagctcactgcagcctccgcctccagggttcaagggattctcgtgcctcatcccgagtagctgggattacaggcatgcgccaccacgcccggctaatttttgtatttttagtagagtcggggtttcaccatgatggtcaggctggtctcgaactcgtgacctcaagtgatctgcccgcctcagcctcccgaagtgttgggatcacaggccaccgcgcccagtcaactttttgttgctattgttgttgctttgctttttttattttattttgctttttttgtctacatcaagggtatccaatcttttggcttccctggggcacattggtagaagaggaattgtcttgggccacacataaagtacactaacagtaacaatagctgatgacttaaaaaaaaaaatcgcaaaaaaaaaaaaaacctcatgtgttttagaagtttacaaatgtgtgttgggccgcatgcaaagctgttctgggccgcggcttggacaagcttggtctacatgcttaacttgaaagtggctgagaagaaagaggatgggtataactgcatctgctgaggagtttccagggggaaaaaggatttaaacctgaatttcaaatatgtctttgaacatggcggttagactaaggtaccccaaataaggacagttagctggagaagacaccgcggcctctaaggggaacatcactacaaaaatagagttgagatagtaaccaacatcagaatctcagtcttaagggaggatgaatttcataagaccctgacactgtggacaaagaaaatggatgggtgtttaggctaataagctatgtaagacataggatggcaagagctgagcaaaaacactgtgtgagaaagatgaaggcaacaattcaaaatgtaggaaaaagcagccaggcatggtgtttcatgcctgtactcccagcatattgggaggctaaagcaggaggatcacttgaggccaggagttcaacactagcctgggcaacatagcaaggcctcatctctataaaaaataaaattactgttgggagggcaacatgggcggatcacaaggtcaggagttcgagaccagcctggccaacatggtgaaaccctgcctctactaaaaatacaaaattagccaggcgtgggggcgcatgcctgtaatcccagctacttgggaggctgaggcaggagaatctcttgaacctgggaggctgaggtttcagtgagccaagatggcgccactgcactccagcctgggtgacaaagcaagactctgtctcaaaaactaaataaataaaataaaattactggccaggtgtggtggctcacacctgtaattccagcactttgggaggccaaggcaggcagatcacttgaagccacaagtttgagaccagcctggccaatgtggcaaaaccccatctgtacaaaaaaaaatacaaaaattaggtgggcatggtggtgcctgcttgtaatcccagctactcgggaggcaggagaatctcttgaacccagaaggcagaggttagtgagccgagatcgtaccactgcactccagcctgggcaacagagcaacactctgtctcaataaataaaaaaataaaaataaacattttttaaaaatagccatgtgtgttggcatgcctgtagtcccagctactcaggaggctgaggtggcaggatcacttgagcctaagagttcaaggctgcagcaagttacagtcccgctactgtgccccagcctgggcaacagaacaaggcccattctctgaaaataaaaataaataaattcaaaagttattttaaagatgtaggaaaaagctttatgcacaaataaagccatgtctttattttttataatagtgaaaaatcagaaataagcagaccctcaataaggaactggcaaaaataacaatatggtataacctattgaaataaatgccgctattaagtcatgcatcttaaaatcataatgcaaataaaatgacataaaaactgttcataacatcatgagaaatgaaaaatgagggtacaaaattatatgttttttaaaccttggaaataaaaaacattggtagaaaatataccaaaatttttaccattggttatgtttgaacaattgaaatggcttttcccctacttttttctctgtgttccagtgtaacaagaatatagtagggccgggcgcagtagttcacacctgtaatcccaacactttgggaggctgaaatggatggatcatgaggtcaggagtttgagaccagtctggccaatatggtgaaaccccgtctctagtaaaaatacaaaaattagccaagcgtggtggcacttgcctgtagtcccagctacttgggaggctgaggcagaagaatcacttgaacccaagaggcggaggttgcagtgggccgagattgtgccactgcactccagcctgggcgacagagagagactctgtctcaaaaaaaaaaagaaagaaagagagaaagagagagagagggagagagagagagagacagagagagagagaggaaggaaggaaagaaagaaggaaggaaagaaagaaacagaacatagtgtaacaaaatcaaaacattaaaaatataaggcctaaaacacaacagattcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtatgagtgtgcatgcacttgtgtgtgcatgcctaacatccaaaactagatataaattctttaaacttttcattagttggccaggcacggtgactcgcacctgtgatcccagcactttgggaggccgaggcgggcggatcatgaggttaggagatcaagaccatcctggctaacattgtgaaacccggtctctactaaaaatacaaaaattagctgggtgtggtggcatgtgcctgtaatcccagctacttgggaggctgaggcaggagaattgcttgaaccagggagtcggagcttgcagtgagccgagatcacaccactgcactccagcatgagactctgtatcaaaaaaaaaaaaaaaaaaaaaaattctgcgtgagttgtgtggaggtgtcagtacctttccccagcaagagaagcttctccatatcaggcatatcctagccatgaccctgaaactaaccagccaagagggaaatgtgagacaagcccaggcaagcttcctggatgttgtatgcaggaataggatgtgctctctggacttggagacttcctgcctgctcaagaggctgtgcctccttgtgtctcccacaggcctctgtgtccaccttccccaccctggcaggcctgctaggccagcagccctggagaggaaagggtgaggtggtgtttgaagggacctgcctcctacgagctctgctggttggactgtcggatgacagaaccgtgcctctgagcctgggagagggaggcacccctgtgttctggaagcccccagtgcttcagcaactcctcactgaggcagaatagtggaggaatcaagctgggatccaggggactgaggaggggatagagcagcacctgggccccacattcccttccaacagagcctggggtgctgtgtttccgggagggttttttttgttttttgttttcccgagacagaatctcgctctgacccccagcctggagtgcagtggcatgatctcggctcactgcaacctccgcctctcgggttcaagcaattctcctgcctcagcctcccgagtagctgggattacaggtgcacaccaccacacctggctaatttttgtattttttatagagacggggtttcaccatgttggctaggctggtcgtgaacttctgacctcatgatctgcctgcctcagactcctaaagtgctgggattacaggtgtgagccactgcacccggcctctttttttttttttttttttttttttgtgagacagagtctctgtcccccaggctggagttcagtggtgcaatctcggctcactgcaacctctgtctcctggtttcaagcaattctcctgcttcagcctctgaatagctgggattaccgacatgcaccaccacgcccatataatttttgtattttttgtagagctgaagtttcactatgttggccaggctggtctcaaactcctgacttctggtgatccacccaccgtggcctcccaaagtgctgggattgcaggtgtgagccaccgtgcccggccagagcctggggttctcaaactcgtttctggggaccgcccaccacttttcttgccagtgcccatcttccaggttcctcccaggctgcttctgcctgccttgtcctcttcctgcctgtcacaccacactctcccaccagcatcttcctcattccgctctgactctcctcaccacccagcccgacctgactgaaaaccccgcagtgggagagcaggaggcccctgcttctaggtgccgtgtgagaagcagctgtgaggtcgggttgggtggctcacgcctgtaatcccagcactttgggaggccgaggtgggcgggtcacaaggtcaggagttcaagaccagcctggccaatatggtgaaaacccatctctactaaaagtacaaaaaaaatagccaggtgtggtggcgggtgcctgtaatcccagccactcaggaggctgaagcaggagaatcgcttgaacttgggaggcagagggtgcagtgagccgagatcatgccactgcactccagcctgggcaacagagcgagactccataaaaaagaaaaagagatttaattggctcacagttctgcaggggttacaggaagcatagcacccacatcactcagcttctggggaggcctcagagagcttttactcatggcagcaggtgaagagggagcaggcgagtcacatagtgagagcaggagcaggcgagagagaggccagaggtgccacacgcttctaaatgaccagatctcgcgggaacccactatcacaaagacagctctgagccgtgagggatccgcctcatgatccacacaccttctgccaggccccacctctagcactggggatcacaattcaacatgagatttgggtgaggacagatatccaaactgtgtggacagaggtgatgctcctctacttgttgaactcttgaacactagtgaagagaatgctggtgtattagtctgccaggctgctgttgcagaataccatgaactgggcacttaagcaactgaaatagattttctcacagtgctggaggctagaagtccaagatccaggtgccagcaggtttggtatctcctgaggcctcgcccctgcgcttgcagacagccgccttctcactgggtccttacagggcctttttctttgagccagtgtagagagctctgttctttcttcctctttttataagcacaccagtcctatttaattagggtcccaccctatggcctcatttaatcatttgttgttgtgttttttttttttgagacgaggtctcactgtgttgcccaggttagtctcaaacccctggtcacaagtgatcttcccacattggcctcccaaagtgctcagattacaggtgtgagccattgcgcccagtctcatttaaccttaattactaatttaaaggtgccatcatggccaggcgcggtggctcacacctgtaatcccagcacttttggaggccaaggtgggcggatcacttgcagccaggagttcgagaccagcctggccaacatggtgaaacccccgtctctactaaaaatacaaaaattagctgggtgtggtggcacatgcctgtaatcccagctactcaggaggctgaggcaggagaatcacttgaacctgggaggtggaggttgcagtgagccgagatcacgccactgcactccagcctgggtgacagagcgagactgtctcaaaaaaaaaaaaaaaaagtgccaccaccaaagactgtcatattgggggttagggcttcaacctacagatttggaggaaacactatttagtccacaataactggagaagttgaatttagaagatgggggttggggccaggcacagtgactcatgcctgtaatccagcgctttgggagaccaaggtgggaggatcacttgaggtcaggagttcaagaccagactgggcaatatagcgagactccctctctacagaaaatttaaaaattagccaggtgtagtggtgtgtgcctgtagtcccagctactcggaggctaaggcaggaggatcgcttgagtgcatgggttgtaggttacagtaagctatgattgtgccactgtactccagacaggggaacagagcaagaccctgtctcagcaacaacaaaacaacagggagatagggggtcaggtgctgacttcaccttaacttcactgtgtgcttttacagcaagcctgttaccctctgtgagcctcaacttctctatgtgtaacaaatggccaactttatgggattgtcaagaagctgaaatgagaccctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcagtaagcacctgcggagggaggagaaacactgagctaagacggggtcgcagctggggagcctgcggagggaggagaaacgctgagctaagacggggtcgcagctggggagtctgtggggcggtctgcacaggtctgacttctctggtctcagtgttcttccgtcctgtcatgggggagaattctgtccatggcaccccctttgaagcataacccatggtggggaggccgtgaggggtttctaggagagaaaggaccaagaagcagaatcgcaggccccggatctccctgaccgtgagttcgcctgagctgctcagcagcttggcatcacaaaccttttgcacattacagccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggggaggggtgcatggggagggtgggggcaggagagggcaggggtgcttggggaggggttgtaggaaagaggaggggtgcactgggagggtgggggtaggagaggggaggggtgcactgggagggtgtgggtaggagaggggaggggtgccctgggagggtgtgggtaggagaggggaggggtgccctgggagggtgggggtaggagaggggaggggtgccctgggagggtgggggtaggagagaggtggggtgccctgagagggtgggcgtaggatatgaagcaacagtgactcctaccccaggggcccaagggtcctggggcagggtggggtcaggaatcgggagggatggggtgtctcttcccccatcaaccctctggctgacaggccaccggactcctcagtcacagcaaggaacctgtcctgctcctgggagcagggcgcctgtggagaacggccccctcacagcctgcccacactgctgcgatgtccccgcatgtctgcacatcctccctccgagacggtcccatcgtgcagtgcggggcttgcagtgtgtaattctgtgttgaggcaaattaaccacccagggtgttaacaactcacaactttaatccactgcccacccagatgtctgaccggggcccaaggaaagatgggtgtgtggttggcctttcaagcgggtgctctagatcatggggccaggagacgccgttgtgcaggaatgcatttagtgccttcaaatcacggcacctctgagaaagcaccgtctacacacttcagcaacatcaacccccctgacgatctcttctacagaaaacgttcccatcagaaaagtctgttttttttgtttttgtttttgttttgttttttgttttttttttgagacagagtttcactcttgttgcccaggctggagtgcaatggcgcggcctcagctcactgctacctccgcctcctgggttcaagtgattctcctgcctcagactcctgagtagctgggattacaggtgcacaccactacgcccggctaattttgtatttttagtagagatggggtttctccaggttagccacgctggtcttgaactcctgacctcaggtgattcacctaccttggcctcctaaagtgctgggattacaggtgtgagccacagcgcccagcccagaaaactcttaaaggggaaactaaaaatgatggacagcgagggaaaactaccagctggagcatggcttttggatgagtggaattcagagccctggctgtccgccaatcaaacactaaaagcacttgccgcactgcggcttcgtgtgaatttcacccctcctcctgactttattcccctagaaattataacatttggagaaacccttccaaaaatgtgaaccaggaggttagcaaagaggtggcctaatttgatatctgaagagacaagcaagatcagaaggtaaaaccttaaaaccaggctgctggggagttccttgttctgtcctgaggtcctagctaggtgagcacgtcatcggctagatgtccaggcaacaacagaagtgatcggctcaattccatggaggaagagaccgcacattctctacatctgtgtctctccctcgccacccagcaaggcttttctttcattcttccttcagtcggatatttattaagtgatcactacctgacagacacttggggggctagggatataacgatgaaaaagatgtaatccctttccttgaggagcttaaagtctagtggggacactgctgacgcaaaaagcaattctttttttttttttttttttttttttttgagacacagtctcgctcttgttgcccaggctggagtgcagcggcatgctcttggctcactgcaacctccgcctctcgggttcaagttattctcctgcctcagcctcccaagtagctggaattacaggcatgcaccacgcccggctaattttgtatttttagtagtgatgggttttcgccatgtgggtcaggctggccaaaaagtaattctaatcaagtgtggtaagaaatagagcagacatgagcagggcgggagagggcctctaccccagtaatgtcaggtgactatcaggtgatggccaggcggttgttacactgtctttctaaaataatattggtcacagccagcgttgggaaagacagtctcccaatagatagaaaatacctgaacttggtgatcagcagcttcctggtaagagctcaggaattgggcgagtgggctcaagcatctacactaagaagcaaaatggtggagtttagctggtgtgtgtgaccttcctctagtgctgctccgcgggtaagggaaaaacgcctcaagtgagcatgcgcacgacttcagtaaacacactgcgcatgcggcccctcccaagtgcctgtgcggcaggcaggcgccaagtcaagggtctaacagcacatttgggtgtctcaagtcacgcacttggcccttttccaagtgtactttacttcctttcattgctgctcaaaaactttttaataaaccttcactcctgctctcaaacttgcttcagcctctccctctgccttaaacccacttctgcccctcagccgaatctctcccccgagaaggcaaggattgagtttgctgcagactcgctggattcacagctggtaacagtaagtaccaggcaggggcatccaacttaaggtgtcatggaagcacatggaggaacctaatcctatctggcagaagcaaaacgaagcttcccggaggaagggctgcccatgcccaaacttgatggacgatgagatactaggcaggaagagtattctaggtgcaaaggccagaagttgacagactgaggcaacaggagaaggtaagtgaatggcgcaaagtcacacagacgccaagctgcagagccaggctcactggagtggaagcgtgcactctcatctgtgaggctaggctgttccctggccgtcacctcaccctttcatctctgcttacctgcatctggtgtcaagaatcagaatgggagagacagaacctggagaaaggctgcgtcttcagagtggggctccactcctccagctccagggctggacctgaaggttgtctttccaggactctttccaggagggccagggaggctctgtatatacgtagaggtcacccaggcgtgtgtgtgtgcgcgcccccacgcccctgcccacaggcctgcattgaaggcgcttccgctccccggagagccctgtcctgatgacccaccctctgctcattttcatgtgattctaaggcaggaaacgggagacatggcctcatgagctccgctgtcctgatgagtcactggatgcacccgtgagaaacacctcaccctccgctctccccaggcagcaacacttgccacaccccagctgttcctgtcctcatctgccaccccgcgaagaatttcggctctttgacagaacagcaccgagcagggcagccacccctttttcctcatcactctccttaccttgcccttggctgactcgatgtgttgcatggttcctgtactagacgtctaacttttttttttttttttttttgagacagggtctcactctgtcacccaggctggagtgcagtggcatgatctcggctcactgcaacctccgcctcccacactcaagcaatcctcccacctcagcctcctgagtagctgggattacaggcacctgccaccatgcccggctaatgtttgtatttttaatagagacggggttttgccattttggccaggctggtctcgaactgctgacctcaggtgttcgcctcagcctcccaaagtgctgagattacaggtgtgagccaccgcactcagcctcttgttcaagccccaggccactatcatcttgtaccatactctcaccaaattgctgaggattttgtggtgctctctgtgtgggagatccgtgaccctctatggacaagctcctattcaagattcagttcaaacattcccagtgaagtctgccaggatttctttactccgagttaggtacttctttctctatgctcccattgcattttaaacatctagatattatatacagtaaagtgcacaaatcttttcttttcttttttttttttttgagacggagtttcactcttgttcccaggctggagtgcagtggcacaatctcagctcactgcaacctctgcctcctggcttcaagcaattctcctgcctcagcctcccaagtagctgggattacaggcacgtgccaccacgcctggctaattttgtatttttagtagaaacacggtttctccatgttggtcaggctggtctcaaactcccgacctcaggcgatccacccgcctccgcctcccaaagtgctgggattacaggtgtgagccagcacgcccagcctaaagtgcacaaatcttaatgttaaagtctgatgaatttttacatgtataccctggtgaaccagcacagaaatcaagatacaggacattccaaatccccagaggtttcattgtgtcgcctgtcattcgtatcccttgtccccagtgttaactttcattttggctcttataataattgattaggttttagttgttcttgaatttcacataaatggaatcaaacagttttctttaaaaaaaaaaaaaaaaaaggcggttttgctgtgtcatccaggcgggagtgcagtggcacaatcatgactcactgcagccttttgccttcataggctcaagtgatcctcacacttcagcctcctgagtagctgggaccacaggcaagcgccaccacgccagctgattttttaatttcgtgtacagatggggtctcaccatgtagcccagtctggtctcgaactcctaggctcaagtgatcctcctgcctcggcctcccaaagtgctggattacaagcgtgcgccaccgcgcccagcccagtatggcttttgtgtgtggctttcttcactcaatattctatatgtaagattcatccatcatgtaatttatttttcttttattgctgagtattattacattggatattacaactttttctactcttaatggacatttatattttcaacttttgcctgttataaataatgctgctatgaatattcttctgcatgtcttttgaaggaactatgcactaatttttccagggaatattcttaggagtaggattgctatcatagggcaggtgaatatttaattttggcagatattgccaaacagattcccaaagtagtcctaatttacacacccaccagcagtgtgtgacagttccagtttctacacattctcacaaacatttttaattttaggcattgtggtgggtgtttagtgtaatctccttgtgtttgaatttgcatctccttgatgagtaagcaccttttcatatacgtattagccatttgaagatcctctttgagaagttcccgtccatggtttttgcccatttgttatgggttatctttttttctgttttctggttcattataattccaggtatgagacctttatcaggtaaatttattgtgaatgttttcccccagtttgtggtttgactttttactctctttattatgtcttattttattttattttattttattttattttattttattttattttattttattttattttattttattttattttttgagacagagtctagctctgttgccaggctagagtgcagtgccacgacgatcttggctcactgcaaccgccatctcccgggttcaagagattctcctgccttagcctgccgaatagctgggattacaggcatgggctgccacgctcagctaattttcgtatttttagtagagacagggtttcaccatgttggccaggatggtctcaatttcctgacctcgtgatccaccctcctcggcttcccaaagtgctgggattacaggcgtgagccaccccgcctgggcttacttgaagagaaagtactgattttaattaagctccatttatgcatcttcttttatggtcaatatttttgtgtctgcttaggaaatctttgcccacttcccactggagtgtgactcacttcttactccaccgctgtgaggtccttgcaggcagggactaactcttactctgctctgtatattctgagcctcacacagagcttggaacatggtagaagctcaagaatgacttgatgaatgaattaattcgtgcaatgcataattcatgcaacacagtctctgcacagagattttacttccagtgatgaaaacaaacgattactgaggaaacccctgatgcacatacatgagaagggatcgttatgactggctatcacagttccatttttaaaaataaaattggaactcttcattaattttcgtgtcatccttgcacgggaaccacgttaaactaatctgcatcgtcccaattttagtatatgtgttgtcaaagcaagcacagtttaagtcttctaaactgtttatgagctgctttctatataagaatttctgtttttttttttttttttttttttttgagacggaatcttgctctattgcccaggctggagtgcagtggcgcaatcttggctcactgcaacctccacccccaggttctaagcgattctcctgcctcagcctcctgagtagctgggattacaggtgcccaccaccatgcctggctaatttttgtatttttagtagagacggggttttgccatgttggccaggctggtctcgaactcctgacctcaagtgatccacccgccttggcctaccaaagtgctgggattacaggcgtgatccactgcacctggccagcaaaagagatttcgcatgcagtgtctgttagaacatctcatatttaggcaatcagaataactgaatggctgattgccgtatatcactcagattttttttttctctcgatatggggtctcgtactgtcacccgggctggagtgcaatggcacagtcttggctcactgaaacctctgcctcctggattcactcgattctcctgcctcagcctccccagtagctgggattacaggctcacactgccacacccagctaatttaattttttaattttctaatttttagtagagacagggtttcactatgttggccaggctgctctcgaactcctgaccttgtgttccgccttcctcggcctcccaaagtgctaggattacaggcgtgagccaccacgcctggcctagcactcagatttttagatgatatctccatgtccaacccaatggcttatgtagatatcattaaaatgttgcttgtgggacaaaggaaagtgctggaatttgtttttaatcccttaaagtgtcaaacttagtgtggggctggtgatggcagctgtgggtttttgctccttcgggtaaacttgtgatgattaattcaatgattatcttatggacaagacacttctttcttttttttttttttttgagacggagtctcgctctgtcgcccaggctggagtgcagtggcgcgatctcggctcactgcaagctccacctcccgggttcacgccattctcctgcctcagcctcccgagtagctgggactacagcgcccgccaccacaaccggctaatttttgtatttttagtaaagacggggtttcaccgtgttggccaggatgttctcgatctcctgacctcgtgatccgcccgcctcggcctcccaaagtgctgggattacaggcgtgagccgccgcgcccggctgaacaagacacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgtaatcccagcacttcgggaggcagaggccggtggatcacttgaggctgtaaccgcccaaggggttcacttgcccgctgtctagacagagccgattcgtcatgacaggggaattgccatagagaaagagtaattcacgcacagccggctgtgcgggagaccgcagttttattattactcaaatcagtctctcccagcattcggggagcagagtttttaaggacagcttggtgggtgtggagagccagtgagccgggagtgctgattgatcagggatggaatcacagggagtcagctgtcttcttgcgctgagtcagttcctgggtcggggccacaagatcagatgagccagtttatccacctgggtggtgccagctgatccatcaagtgcagggtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggttggatctctttcactgtctcagtcatcattttgcaaaggcggtttcaaggccaggaatttgagaccagcatgaccaacatggtgaaaccgtctttactaaagatacaaaaattagctgggcgtggtgtgcacaaccgtagtcccagctactggggaggctgaggtgggaggactgcttgagtacgagaggcggaggttgcggtgagccgagatcgcgccactgcactccagtctcggcaacagagtgagactctgtttaaaacaaaaaacaaaaacaaacaaaaaaagtcctggcgcggtggctcacgcctgtaatcccagcactttggaggcggaggcaggtggatcacgaggtcaggagatcgagaccatcctggctaacacggtgaaaccccatctctactaaaaatacaaaaaattagccgggcgtggtggcacgtgcctgtagtcccagctactcgggaggctcaggccggagaatggcgtgatgaacccgggaggcggaggttgcagtgagccgagatcacaccactgcactccagcctgggagaaagagtgagactccgtctcaaataaaaaaaacaaaaaataaagacttaggagaacaggctagacagatgttccattctggggtatatttggggatctggaggtggtatttgagcaagaaatagaggaagttgatgaaatagaattcactggcagaagagaagatgatacagccagacaaccaggccagctgttttctagtgttccccagatgagagcgacaggactaatcagcctcctgtgggtgggctctaaactcaactgaaagctgacaagagagcacattcccttaattggagggagaaaaaaagggaagatattgaaagagctgccttttataccagaccactgaagaggaagttagggttttctcattagtatataaaaatcgtaaacttccacccacccaaagtagatttctgcctccaacattgcactgaaactgttcttggtctccagtgatttcgtgtctctgatgaacgctacactgtcctctttacttgactctagacatagttagccacaggatccttcttgaacattcttactcttggctcccttgacaccccactctggtgtttttttgtttcttttttttgagacagagttttgctcttgtccctcaggctggagtctggagtccagtgtcaccatcttggctcactgcaacctccacctcccgggttcaagcaattctcctgcctcagcctcccgagtacctggaattacaagcaaccgtgccaccacacccggctaatttttgtgtttttagtagaggcggggtttcaccatattggccgggctggtctagaactcctgagctcaagtgatctgcccaccttggcctcccaaggtgctgggattacaggcgtgagccactgcgcccggctgagatttctcctttaaatagaacgttgtggagtttacttttaggctgagacctaaaggataaaagaaagtgatccgtgctaagacgaggagaactcaagcagaagacatgcctcggctgtggagcaggaaggtgtttgatgttggggtttgagagaaggccagtcagctggcaggcagggggcaaagggggtggcatgaagcaaggagcttgggcattctgagtggaaggagaagccagtatgcggagaatgggtcggaagagagtaagagcagagactactgcagtggtcacgataaaaagcaggtcacttggaccagagtaatggcaatagactgaaaagtagggttaccttttatgcattttggaggcagaagttaaaggacttgctgttggattagagatgggggaataagcaaaagaaaatgacttaagtttctggcaggttcataggtagtggtgtcactgcaggtctgggtggggaggcgtcatcttagatgtaagtgtgatacttccaactataggcgcagtgtaaaaagtcggacatgtgagtctgaagcttggaggagagacgggctggagttggagatgtgagaaatcattggcattatacatggcggttggtactatcagaatgagatcacagagggagagttagagggccaggtcctggggatcaccaccataaagacccaatcaaggaggtgcaggcagtgagaagaaacaccaggcagggcgcagtggctcacatctgtgatcccagcactgtgggaggccgaggcaggtgaatcacttgaggtcaggaattcgagaccagcctggccaacatggtgaaaccccgtctctactaaaaacacaaaaattagccgggcgtggtggcgggcacctgtagtcccagctactcgggaggctgaggcaggagaattgcttgaacctgggaggcggagcttccagtgagctgtgatcaaatcactgcactccagcctgggcaacagagcgagactctgtctcaaaattaaaaaaataaagaattctctactggctccttttctattttttttttttcattctattagaatcagatctgtttttccatgtatgtttatcgtctgtttccaactagaaagtaagttccttgagggcagaggctgtatctgttttgctccccatcacatacatccctattatttggcacatgaggctggagcatggggatgagaaatggttccacaagaaaagggggggcacaaacccatcactgtagaactgtgagctaagcagcagtccctttttttttttttttttttttttttttgagatggagtcactctgtcacccaggctggatgctatctcggctcactgcaccctccacttcccaggttcaagcaagtctcctgcctcagcctcccgagtagatgggattataggcactgccaccacgcccggcttttttcttttttttttttttgagacagagtttcactcttgtcgcccaggctgcagtgcagtggcacgatctcggctcactgcaacctctgcctcctgggttcaagcgattctcctgtctcagcctcccaagtagctgggattacaggcggccgccaccacacccagctaatgtttgtatttttagtagagacggggtttcaccatgttggccaggctggtctcgaactcctgacctcaggtgatccgcccatctcagcctcccaaagggctgggattacatgcatgagccactgcatccagcagcaataacaatttctgtcataccatataatcgtatctcctttttgcccattaatttagtaattatctttccttcaattaagctaagtccttaattaaccattagtaattactgctggtctgaaagaacagacactgaatattcgcccaagtatgtcaaacacagaatcatacttacctaacaagcctagcttacccaatgtttctgtaacaactggactaatatttacagagtgtttaccatgaatgtttgacataccacaaagagcagaaaaaaggctagcaaacgttacacataacaacgggactacaaagtaacctttgtcaatcaatagtaactgacctaaatgagaacgtgagggggcaagcttttggaatctcaattgtattactgaaagtaatatccagagtcttatcttgtaaaaacaacaacacaaaaaaaactaatactgaaaagtttttgtttttatttccaagatcaaatattacaacaggacatttacatgtatttataaaaaaatgcagcagttgaatgtatagatcagaggtttccttgagtttggtccctctctcagcacagtgagctgatgtcttcaaaagacttatcgtcccactcccttccctcccccaccccattgtccccccaccctccccgtttcaagttgcagtattaatataaagcaactgggtacaacacagcaagagtattcacaatttggtacagaccaaaccagaggatccccaactgacagcaagatcctccttctggaaattattacctatagactaggtagatctataggtagatcacacccagttatctaagatttccctggttttagagcaagtggaagttccattgagtcttagccagtagttacaactctgcgttacctaatggcatgtttttctcctcttacaagtttaattttctaccgcctccatgtgtcttcaaatttaaggctttcccaagcacctttattatgacttactagatatacaggagggtctctaatgtgtcttgaacaaaaaaatttagtggatggtccagctgccccttgctcaacaatcccaaagacttcttcccaccactgagaagagctgcagaaatcaacggtatctcctagcaccattggagaaaaggcccagaaaacagaattcgatgtgcattttagggagcacttgccagaaacattacaacaggagcactgtctctgttatcttcttggattcaatcacaaatttagagtacagatgaaatttagagcctgtcctgcattaagaatgcaaatctcagtaagaccacccccacacacactttgtccagaataagttgagccacaaacatcccagggaatctctaaatactgttaggaactgctttagaaaacactttaaagcaaataccccaagttgacttcactcaagcccccaacccaccctcatcatccctatccccctagaaatttcattccttgattaacttctctgagtaagatgtaaagtgaggtttggaaaatgacatgaaacatgaaacatgtttaaaaacacaatcaatgaagacatgccagaactggacatcccaggtgacttcaaatgcattgttcaagccgaactcatacaaagcatgcacagagcctgcacagacactgctgagagtttccagggaacaatcaatacctactcgaaaaaggactttcctgaagggcaaacaaaacaaaacaaaacaaaacaaaacaaacaaaacaaaaagtaacactggatgtttagaatttgttaacaacaacaacaacaaaaaaccattctggaaaaaaagattatcagaggagtgaagaaaaccgtgtctaacagattcatgccaaagcttggatggaagcccctcaaagtctaagtatcgtgttagcatcaactggtactcatttctctatatctaagactagaagattctctcacagctttactgtttcctggcaagtgttttcaacagcctttccagctgaagggacgaacccaggaaagtaacaaggcccaagaccccacatgggtcagataagcagcccctactagaagcttgctactcgttaactgaaaagtggaggccacgcactactttcactctctctagcaggtgaaaggggattttctgatggcaacagtcactccgtgtaaggtttaacttacagggcaataagttatcaaaaagttattgttaaaagcatatgattagtgtcataaacatatttatatttggaattacaccatttgatatctccattaagaatgcaaagctttgagaaaagcatactgtaaaatcatgttgctgcaaacagcaaggcatccagctgagtgtaagcagtctaatgtcatcaaactgaaatggaccctcgtgacgggcactatggaaccagctacctagatagagagaaaaaaggagaatggcagggaacggttccagatcaagaatctctcccttatcagttaagagttccatactgagtctatgaaaaaagcaaattaaaaagattttaagaaagggggaattcaattccaggtcagaatttatctaatgatttgatatgtttcccatttatcatgtctaaaaaatgaatgactcatgctaacccagttagattaataacttcttttgatgagaaaaaatattacttaggtttagtccagcttagcttgactattcttcccatttgaaaacccaaatgacctttagaagggatataaaatacccagagtattgtgatctctagagaggaaatacaattaaacaataaaaacttgctgtttgttgccaaagaattaagtacaataatgcgacttctcatatttatagattaatctgtgattgctcttgggaaaaatactatcattggtatttgccatctctaatcctagaaataaatctggttatcttttgaaaatactttctcattacaggaatgctaaattatgtttattaaagtagttcaaattggattgcccaactttattttgaaatcaatagcaaagaaaggcctgtgccaaaaatcatcatgtttatgagaatatctgcaattttaagcaacacaacagcaactggtaggccacaaagagggtggggtatcacagagctagccattctctatatgaaaccagagaattctccttaactagggagaaaatgagctataaaagtaagtttgcctcaaaaatgtccttcaattttataaaaaatgaagattgttacatattaagactttgaaatggaatttcttaaacatagccaattacactaaaaatcataactattttcagagaatgaatgttaaaaataaatggtggagaagtaaaatggaaagcaggattaaaagatttctaattaagggtctgtcacttcacaggacaactagcaaggccattataatctctatttttaaaaagacatcaagaaattcttgattctatactgtctctctagcaggactgacacacaggtgagtcaaaaaccataaccatcactgaaataccaaatctctatgtaacaggagaaaccgatatattggtatggtattctctgttgggttatctgcagttctaaagaacattcttgccactattctaaaatgtgtacagtgcaacaccatgtttcacggcaagacaataactgaaaagctaagccaggcaatccagtgaagttgaatgtccatagtacacagctgtctttagcctattcatcaaggctggtattaccggaaaactgccatgttcaccagaagagctgtctcttcctatgctcattacattttagttttacaaagactactaattcatcagcctgcaccccatgatttactactgcgtagttacatgatggtcaaaaaaggcagagagacggtaagaatgacataataaagatacattctgtggaataaaaaacatttttaagtcagcctaattgtatctttaaaaagctgtttctgccaaaaccaggtgtgaatcttatacaaatcaatttcccaacaggccagtaaagtactttaagtacacaagtaaaaataaaatttagtgccagcgttagtgtcatatttggttctcatttacattttagtcatactcaacactgattaggcacacagcattaagttttaaaaaataatgaattgtttacaagattattattactagacctataactactatactctcctctttggagatttcagtcatcgcagtaagattaagagcaagttgttggtcaaatgatacctgaacacagaataaaaaaaagagagaaaaaaaaagtaaagaaactgattaaccagcacacttttaattagcctagggataatacgcaatcacggggagagactggaagcatgaaattttggaaaaggacttcagagataatctaatttgttgttctagaaaaggctgagaactattaatctagtccaattatctcatttttcagacgagaaaccagagattaagaagaaagagaagtgtgaaggtaacaactagcagagctgttacccaaagggctctcacacctccagtgccctttctgcatataacatatactatactatgcattggatttgtacctgggtagagaaattaaatctttccttcatttttcggttgctagtggctccctctggtattttccctaagtgtgcaagtaagattcctgcgagctaggaatctttactccgggggatcaatagtgagatccccgcaagctaggaatctttactccagggatcaataatcctttcctacttgggtactggttatgccttagtggcagaacttcatgccccaaatctagaagttacaaaaggtggagctaaagaaaaaggtgagtcaaaagaaaacgtgagctacagtgcttgccacttcagtcttgtttaagactttgctaactaaaacatattcttccctttttctaagtttgaactaataggtaaacatttacatgctctccaattatttcatgtgtagtgtgtctctctaactggataaaacaggcaggaatcatatcttatttattattttttgagacagagtctcgctccattgcccaggatggagtgcagtggtgtgatctcggctcactgcaacctccgcctcccaggttcaagagattcttgtgcctcagcctccccattagctgggattacagacagccaccatgcctggctaatttttgtatttttcagtagagatggggtttcaccatgttggccaggctgatctcgaactcccaacctcaggtgatccacccacctcggcctcccaaaatattgggattacaggcatgagccaccacacctggccaggaattagatctcagatttcaaaatacttccaacttctataaagaactcaatagctaattgttgacttgtaagtcaaggaagtagaattatatacaagatttaaaaacatacacacagagggttcaataatctggtatggatgggacacagaaaacagaattgtagatcgggcgcagtggctcatgcctgtaatcccagcactttaggaggccgaggtgggcggaacacgagatcaagagatcgagaccatcctggccaacatggtgaaaccctgtctctactaaaaatgcaaaaattagccgggcgtggtggcgctcacctattaaaaaaggtaattgtatcttttctgaaaaatgtttaaaaaaagaaaaaattgtttttttacccttttcatttattcttggcaaataatgccacgtggcaattttactttcacatcttcaccagtgcatcattttaaaaaagcaataatcagcctctcaaaataatggcataaataaaaatgtataggcatagtgcaaatcccacaactttaacccaactacttcctctatatttatgggaacaaaactaagtgacactttacaaagccaaacaatgagaagagaatcatctgggtagcttgattctcttgctgaaggagaccacagcatggactctggattccaattctgatttgccactcactagctatgagtcctgaataagttctctatacctgttttcttaacatgggaagaaagtatacattttgtacgattcttcgggagattgaagaggcaaatgtacacaaaagtatctggtgcatgccaattagtattaagtttcctgttcttttctcatttggcactgttgttttctcttctccagttccttccgataccaatttcaaaaaagtattcctctcacttttttcccactagttttcttcttcttcttcttttttttttttaaatttgagatggagtgtcgctttgtcgcccaggctggagtgtaatggtgcgatcttggctcactgcaacctctgcctcccaggttcaagccattcccctgcctcagcctctgagtagctgggattacaggtgcacgccaccacacccaggtaatttttgtatttttagtagagacggggtttcaccatgttgctcaggctggcctcgatctcctgaccttaggtgatctgcccacctccgcctcccaaagtgttgggattacaggcatgagccaccgcgcccggccttcctggtagtttccattccatctccctgtatttttctcttatcactctcgaagtctatctttcttgttcttttcctccctagctttttttttttaaacactcctttcaagctgtgtccaacacccacaaggaatgactatttttaactaatcttactgacctcatttaatctattcaataaaacctctgccctaaggagcaaagaaacttgcagaggaagtaaggcaaactggaagaagcatactgtcagcggattaaattcttgagcaaggcaatactccttatggattcttcccatgtacaatccgtaactcttcccatgggcctttatatcaaccctaagataattacactcctgcctcaaaataaaataaaataaaacccaccacatcttgtattgtagacatcccagctgcatgttaagctgagtgaaagtaccatgctgtcttttaaatcactttatatctacttaatcatcccacagtaacccgagttgaagaagttactttggtttctcataaatgaatatgcacgtgctgaacatatcggaaagaaccacaccctctcactgatgaacacgttggcagttctcccaactgttttatcaagagaagctagaaggtaaagaaaaggaaacagagccctataggaaaaatgattgacttcacacgtttgagcgatttgggcttcagctatgactttgctggagtacagatgggtgccatcagagcacaaagctgagcaaacctctcttcttaccctgtgccctccctgaatttttggatttctgagcttgtctactaccaacaaatgttttaccctccagtgcacctttgacagtatacagctctatttttcaaacggcaagtatgttatccaagttcagagatgcaactgaggaattaacatgaaaaccatctttcactcaataaatcagaagctgctagttaagtaagcctcaagaacctaagaaaaaacaccaaagtgtaagtattactcagtcaccaatctaaagacagaactttgactcaaggtagaaatgaaaccgtaattatataaatatatttataaatatttatacaattatatacttatacataagcacttacacagacttagaaaaaaatttaagaacattaattcaaaaggactcactgaagaataaacagatttttccatgatttccttgaggagatataaaactcattctttagggagagttcctcaaaattcaaccattagaaaccatatcctataactgtgtactagcaacacatggcatctttttttcttcttttcccaaatcccctaattgccaagagagcaatcttaaagtagatgaaaacctaaaggtctctacgcaacatctgaggaacatacgctcctcagataaaagaatcaatctaaatcctcaactgacaaaaaggtccatttaatatttttcattttacaagttaaaagttctagttttgccaccagaatcacgactacccccccttcagaggactccatttaagctcaaaatacgaaatgagcatagggtgaagttgatgtgtaaatggtattctacagattcaagatggcctcttctaaaaacactgaagaaagctttcaccaactctaatttgattttgggttttgttggcagaaaaagcccaagacatctgaaaattactagtaacctccgccatcctccttactaaatgttgtcttctgaatggagttgaaaggtcttccccttagagaggctttccgttttgataccttttgaaagaaaacagcatgcggactcatgttcaattcagtcaccagagccttttagagactattccaaccaggggcaaaaaatgaaccattatttctaaccaaaagaacatggttagcaactctcagctgaatggttttctttttccccagggacatacctaagtatgcctgaaacaacacaggacaatcaataaccatagtggttacaattccaagccattgtactacatgattattgaccagctgccttcctacagatcactgcagactcagacaatggagggctccaaaggaactaatatgctgtgctggcaaaaatagcaagcaccttcctatcccagtcaccacgataggttcacttcatgtccattcttggactagcaggatcaatacagagtaataaggaaaactgtctcaggttaggacaatgaaagtcaccccatgctatatgctccatatttaacactcattctgccaataacacatgtcatggaaatagtccttatagctgggaacatgaaaatcctttgaaaaaggtttttaagtatgatgagcaatcattacaagggatgctttttccacgtaaacaaaagcctggatattttgttaagcgacatttccacatgaagaacacaacaaaaccaaacccatgttagagaatttcttctccctgctaaacacggggacttacaaaaaagggagggttgttcttactctgaatctagccattcctttgcccgaagagtctggggagtaacgttaacatttgatcccaaaaaagtgccgtgcaagagaccacttactggaacacacaattcctgctgctagtactaggagaggtcttatccttacacttcagtttggtcaccagattaggtaagaaagaaaagtgtggggggagggggaggcagaagggtacggagtggggagcgagaaaacagaagaggagaaagaaacaaagggggagaaagagactgattataggagagatcaagaaataagagaaggaaggtgacttgcttgcccaactttggctctgtggtcctatgagccaaaatgcatacttagtgacatgtatctcacaggaaaagggaaaaaaggggtaagctgagagaggtcaagccatggtgttaatttctttcctgtacaaagacagtctcttgaggacaaaggcctgcctcttgcaatgtaatatcatagtccagatgagataatttccttcgaggaaagttggtgagaagttcaaaacgttcatttgggtatcctttagactgcacgtgcttcaccaaagcctataaaaacaagagaaagacaaagccattagacggaaaaagaggaaagagcatattagtgaattaaatagaaaacattctctttttaatcatattagatcagctattaaatgtaagttcttctttcatataaccaaagcttgcccttggggaagggccaatataaacctttggacggggagataaatctgaccccaattacttacagccattaagtgatactgaaatacacagttattatttggctccccaataaatatacccagtcactattcataaaattaaattattgttctcattttaaaacattttatccgttttcctttctcccttttatcaaggaagatatgtccttcattctgcctacacccaatcttgccacctgtgcactgaatctcttcttgccttctcagaaactggaccattcccatcttttgcaggtttcttcaacatctccctctctgcttcccatcaaacttcaacactgcttgcatttcagtaacacagtcttcaagaatcagcctaattatctccagccacagcaaacggccagcaatgcctgacgcaagggattcattcacaggctaagctaagctaagctagtcagactcaagattctgtttccagcagttaaaaacagagggtgtcggggcacggttgctcacacctgtaatccctgcactttgggaggccaaggagggggacagcttgagcacaggagttggagaccagctggggcaacatggcaaaatcccatctcatcaaaaaatatgggccaggcatggtggctcacctgaggtcagaagttcgagaccagtctggccaacatggtgaaatcccgtctctactaaaaatacaaaaaaattagctgggcatggtggtgcgcacctgtaatcccaactacttgggaggctgaggcagaattgcttgaacctgggaggctgaggttgcagtgagccaagatcatgccacccgcactccagcctgggtaacagagccaatcttcatctcaaaaaaagtaaaaataaaaataaaaactagccgggcatggtggtgtgtgcctgtagtcccagctaccgggaaggtcaaggtgggaggagaatggcttaagcctggcaggcagaggttgcagtgagccaaggtcgtgccccacagcactccagcctgggcagagccagatcgtgtctacaagaaaaggaagaaaaaaacaaaaacaacacaaaccaaaaaccacagaaagctcatcagctgtgttagatgaaaatgcccgcagcgtcaccatgatgaaccacgtgcgagctgaggaataaacaaaagccaccagtatgcagagaatggtgtgaagcagagaatcccaagagaaaacctacaggccccagaagagaaacatagagaaaaacagacacagttcttaaacactttgcagttccagctgctggaaaaccactatcctcttcaaataaccccagtcgtccttttccagaagtagtcatttcagttgggtttctattccatgcaggcatgaaacagaaaaatcttcactggaacataccttacgtggcttacctaatttaatctgggaaggaaataaactaattagaattaagattcacaaccgggtgctcccacctgtaatccctgcactttgggaggctggggaaggaggatgacttgagctcaggagttcaagaccagcctgggtaacatagtgagaacccttctctacaaaaaagaattttaaaaaattagctgggtgtggtggcacacacctgtagtcccagctacctgggaggttgaggtgggaggctcgcttgagcccaggaggcagaggttgcagtgagctgagattgggccactgcactccagcctgagcgacagagcgaccctgtctcaaaacaaccaaccaaccaacaacaacaagatgactcaccacagtttgcagttagagatcagactaaacatctaacacctctttctttttttttttttttttaaacagagacagggtctcgctttgttgcccaggctggtctcaaactcctggactcaagtgatcctcccaccttggcctcccaaagtgctgggattacaggagtgagccactgcacctggcctcccacacctatttcaaagaattatcaagcaaagctcactgaacttactccaatgaattagcttctctgcttcgagaaaatgcttccaacgccctgtttcattgtgcttcaagttactgaaggtctgcggcaaccttgtgtcaagtgcctctattggctccatttttcaaacagcatgtgctcactgcctgtctctgtgtcaccttttggtaatgcttgcagttcattattttatctattataatgaactgtgagcagttacctttgatgttactattctgcttttgggcaccacaaaccacgcccacacaagaccgcaaacttaataaagaagtatgttctgactgctccacctaatgggagttttcccatctctctccctctattcaggcctccttattcccggagacatgacagtattgaaagtaggccaattaataacctaccagtgtaggcctctaagtacccaagtgaaaggaagtgtccatcctcaaaatcaatcaattgctaaaaatgatgaagcttagtgagaaaggcacgtggaaagctgagacagacacaaagctaggcctctggcaccaaacagccaagctgtgaatgcaaggaaaagttctggaaggaaattaaaagtgctactccagtgaacacacaaatgataacaaagcaaaacaggccgggagcagtggctcacacctgcactttcagaggctgaggtgggtggatcacctgaggtcaggagttcgagaccagcctggccaacatggtgaaaccccatctccactaaaaatacaaaagttagctgggcgtggtggtgggcgcctgtaatcccagctactcgggaggctgaggcaaggagaactgcttgaacccgggaggcggaggttgcagtgagctgagatcgcaccattgtactctagcctgggtgacagagcaagactctgtctcaaaaaaaaaaaaaggaaagaaagcaaaacagccttactgctgtgctgctgaaaaggagaaagttttagtggtctgtacagaaaaatcaaaccagtcacacattcccttaagccaaagcctaatccaaaacaaggttctaactcttttcaatcctatgaaggctaagggagttaaggaagctacgaaagaaaagctggaagctagcagaggttggttcatgaggttgaaggaaagaagccatctccataacatcaaagtgcaaggtgaagcagcaagtgctgatgcagaaggtgcagaaacttatctagaagatgtagtgaagacagttcacgaaggtaacaacactaaataacagatttaagtttgacaaaacagccttctattggaagaagatgccatcaaggactttcacagctagagagaagtcagtggctgcactcaaaggttcaaaaaggctgactttcttgttagggggtaatgcagctggtgacttccagttgaagccaatgctcatttaacattccaaaatcccaggtcccttaaaaattatgttaaatctactctgtctgtgttctgtaactgcaacaacaaaacctggaaagacagcacatcaatttacagcataacttactaaatattttaagcccactgttcagacctactgctcagaaaaaagattcaacatattactgctcattgacaacgcacctagtcacgtaagagctctgacgaaaatgcaaataaaaatgaatgctgtttccagtctgctaacccaacatccattctgcagcccatggatcaaggagtcatttcaacttttaaatcttatttaagaaacacattttggccaggcacggagccaaatctcaacactttgggaggctgcggtgagaggattacttgagtccaagagtttgagacaagacctggcaacacagcaagaaaccatctctaaaaaaaagaaaattaattgggtgtggtgatctactcaggagggtgaggcaggaggatcacttgagccggggcggggagtcaaggttacagtgagctatgaccactgcacaccagcctgggcataaatacagattcctttgatgaatctgggcaaagtaaactgaaaatcttctggaaaggattcagcagtctaaataccattaagaacattcacaactcataggaagtcaaaatatcaacatgaacagggctttggaagaggttgattccaaccctcatggatgactttgaggggtttaagaattcactggaggaagtcactgcaagtggggtaaaaactgcaagagaactagaattagaagtggaggatggcgatatgactgaattgctgcaatctcatgatcaaacattaaagggaggggggttgcttcttatggatgagcaaagaaagtgatttctggagatggaatctacttctgctgaagatgcttttaacactgttgaaatgacaacaaaggatttagaatattgcataaacttggtggataaaattgcggcaaattctgagaagactgactccagttttgaaagaagttctactgtgggtaaaatactatcaaacggcagcacatgctacagagaaattttttgtcgaaggaagcaactgatgcagcaacttcactgctgtcacattttcagaaactgccacagtacccatcaccccaatcagtcagtagccatcaatatcaagaccctccaccaacaaaaagatgactcactgaagattcaggggatcattagcactttttagcaaaagctttttttaattaagttatgtgcttttttttagacataaagctactgcacacttaatagactatggaataatgtaaacataacttttatatgcaccaggaaaccaaacaatttgggactcgtcttattgcagtggtcggaactgaaccaaagcaagcctgtacttactagcagtttagcttgctctggaagagtgatctgttccctttttccatctggataccgcaacatcagctgtgcttttggtcctaaaggaagggtttaaaaaaaaaaaaaaaacgggatacaggagtttaagacagaatattagtttaaataaatatgtaaataaatacagccattcagcaattactcaagtgttttgctggagtgcagtggcgtgatctcagctcactgcaacctccgcctccctggttcaagccactctcctgcctcagcctcccaagtagctgggactataggcacgtgccaccacacctggctaagttttgtatttttagtagagacagggttttgccatgttggcgaggctggtcttggaactcctaacctcagtgatccaccacgcccggccccaatatctaagtttgaagtaaagtatgtctaaatgtaacttaccatttacatctatcccctccactactccatctgctttttcaggtggcatctccagtatctctgaatccacagctggcaatccttggtggtttgtggctgttccaggatcagttctgactggtggctcagtcagcggccttctattctcctcttttctatgccccaaatctttgtggggagactttctggacttggcaagattctctacctcttcttcttcatcagagccacaaacggatatgaactcctcactgccagaaaaaagttcagattcagattcttcatctgagcggctatcctgttttgtctgtgttgaatcaaaatgtgtttcttgtaaggaggctctgatggcagcttctagctggctgtcttcacttgcatctataaggctctcctgtgagatggagtcataaaacacaggaaaaagaacaagttaaaccaaaaaacaagtcaaacggcataagaaatataatagcttgccattcattattatgttctgctgactgtatcccttctactttaagagcaaggactgtgtcttacacagccaaattggaatggagatatatatatgtgtgtgtatatacacacacacacgtttttgttgttttgttttgttttgtttttgagatggagtctcactcttgttgcccaggctggagtgcagtggcacgaactcggctcactgcaacctcagccttcccaggttcaagcgattctcctgcctcagcctcccaagtagctgggattacaagcgcccgccaccacgcccagctaatttttatttatttatttttttgtatttttaatagagatggggtttcaccacattggccaggctggtctcaaactcctgacctcggcctcccaaagtgctgggattacaggcgtgagacaccgcacctggcacatacatacatacatacatacatacatacatacatacatacatacataaatatatatatacacatatttttttttctttctttttttaagagacagggtctaagttccccaggctggtcttgcacttctggattcaagtaagcatacgcatttttttaaatatcaaaatgaaggccaggccgggtggctcatgcctgtaatcccagcactttgggaggcccaggtgggtggatcaagaggtcaaaagatcgagaccatcctggccaacatggtgaaaccccgcctctactaaaaatgattaagcttagtgagaaaggcatgtggaaagctgagacagacacaaagctaggcctcttgcaccaaacagccaagctatgaatgcaaggaaaagttcttgaaggaaattaaaagtgctactccagtgaacacacaaatgataacaaagcaaaacaggccaggcacagtggctcacacctgcactttgggaggcttgaggcgggcagatcacctgaggtcaggagttcgagaccagcctggccaacatggcgaaaccccatctccactaaaaatgcaaacatcagctgggcatggtggtgcgcgcctgtagtcgcagctactcaggaggctgaggcaggaaaatcacttgaacccgggaggcagaagttgccagagattgcgccactgcaccccagcctggtgacagagcgagactccatctcaaaaaaaaaaaaaaatcaaaacgaacaaaatcaagaaaagtttatctattacctgcctagagaaagacaagaattaaaagttttaactataaagtcaaaacaccattctttaaaatgactaaaacatagagacaaatgtttactttgttcaccactgcattcttcaactagtaattccattaattacaatgaaggttttcattatgataacaagaaatgcaaacttctacagtttttcccttggtaaagttctaatgccacagattttactaaacttaatgaatcacaaaatacgttgtttgagtggaacttacttagctcctgactcaaacatactatagaggaaagaaatcgtaagataatctaaaattgaacactggatatttcaggatattacagaattactgctcatttttaagggtataataatgacattgtgatagtatttttaaaaataaaaaaggctttatcttttaaatatatatgccagagtattaattaatgaaacaatgaattctgagattagcttcaaaataattcagatgtgatgggatacagaggaaagaagactggccatctgctgataattaccgaaattagctaacaaagaggctcaataaactacttcaacttttgaatatgcttaaaattttccataataaataggtaaaaaaaaaaagtgtgagttgctaataaaaaactaaagaaaccacattttggcttttactatcaggcaatcatgtagcaaaaaattaaagggaaaaacatttttttgctggttgttttttttttttgagagaggttctactctgtcacccaggctgaagtgcagtggcacaatctcagctcactactatctccacctgccaggctcaagcaatcctcccacctcagcctcccaagtagctgggattacaggcacacaccaccacacccggccaaaggaaaattttaaagtaaacttcaggcgaacttaccacccctaaaaagcaagtagaggtgtctatgtgacatgcaatggcttaggtggattgtaaatttatagcaatgacattgcacatatagcatgtagctcgattttaaaaattgtggccatggcagacactgtcaggctcctattgaatttcattctcctctgatttccttacttatataaccctatttaagtttataaaacgtgttcaactaaaaaattcattttactaatttctcttgtagctagaaaatagtattgagcaatagcaattcttatcgaaaaattatagaattaaatgcttatattagaagagagaaaggtatcaaattaatgacctaagcttccccaccttaaaaaaaaaaaaaaaaagagtatacatccaggaaaagaaaataaaattaagctcaaagaaaacacaaattaataaatgacctagaaagcaaatacaatagagaaaaacaaaaaaaacccaccaaaatcccaagagcagttttttgttttgttttgttttttgtttcttaagagacagagtcttactgttgcccaaagactggagtgcagtgactactcacaggtatgatcatagcacactacattcctgaactcctgggctcaagcaatattcctgccaagcagatgggactataggcacatgccacaccccagctggttccgtaagatcaataaaactactaagcctctggccagacagtcgggggaaaaaagggaagccacaaattcccaaaaacagaattaagagaggggacaactacaatctctacattcattcatggcatcacgagggactataatgaactctgacaatatagtaaaatgaacaaatccctagaaagatacaacttgctaaagcttatccaagaagaaacagataccaagtagtcacgtatctaccgataagattgaatttgtagtttaaaattttccaccaaaaaaaaactctaggcccatgtagcttcactggtaaatgtcatcaaacattaaggaagaaataacaacaattctacagacactactgcagaaaacagaagaggaagaaatacttctcaattcattgtgaggtcagcattaacatgttaccaaaagcagaaaacgacattataaagcattacatggaagaaaggaaacaacaacaacaaaatgctctcaaaaaaactataaatcaagcaggagaactgcttgaggccaggagttcgagaccatcctggccaacaagatttctatactatcccttagggcttttccttaaataggcactttattataggtgataactgaaggaagtgttcctcacatcttctaaaactatttttaggctgggcatggtatggtggttcatgcttataatcccagcacttcgggaggccaagggaggagaattgcttgagcttaggagtttgagatcaggctgagtaacatattgagaccctgcctccacaaaaaataaaaaattagccaggcatgatggtgcacacctgtagtcctagctactcaggaggctgaggcaagaagattgactgagcccaggagttcaaggctagcaagttttttttttttttaaagttctctcaaggctgcaaagactacagtgagttaatatcatgccactgcagtccagcctgggcaacagtgtgagaccacatctcaaaaaatacaatacaatacaataaatacaatacaatacaataaaaatgttgctaggtgtggtgctcacacccagaatcccaacattttgggaggctgaggcgggaggattgcttgaggccagtttgagaccagcctagacaacatacggaggcctccgtctctacaaaactttaacagcttagctggcatggtgatgcacatctgtggtcccagctacttaggaggctgaggtggaaggatcgcttgagcccaagaggtggaggctgtagcgagccatgatcacaccactgcactgcagcctgagaaatggaacaagatcctgcccaaagaaaaaaacaggacgggcgcgttagctcacgcctgtaatcccagcactttgggaggccgagaagggcggatcacttgaagtcagcagtttgaaaccagcctgcccaacaaggcgaaaccccatctctactaaaactacaaaaattagccagatgcagtggtgtacgtctgtaatcccagctacttgggaggccaaggcaggagaatcgcttgaacccaggaggcgaaggttgcagtgagccaagatcacaccactgccctctagccctagcaacagaacaagactctggctcaaaaaaaggaaaaaaaaaaaaccaacaaaacaaaactatttttatccctactgctatcaaagccaaacagccatgaaaaccaatgtgagattgctgtatctttgcaagttcagtctcttatttgcaaccaatcttgataccaattatcaaacatgtctacctagtaatagtatattctagaaattaagtatagaagtaaattctaggagggccagagagccaggccctaaagctatattaaccaataaaaatgctcaactataccatgacagttgtttcagcaaaaacaaaaaacaccacttccagccggctgtggtggcatgtacctgtagtcctagctattcgggcagttgaggtgagaaggctgcttcagcccaggagttctaggacagtctgggcaaaacagcaagatcccactccaaaacaaaaaacaaaacacacaaaaaaaccaaccactttcactgctatttagacctggatatcagaagccctcccagagctgcccctcaggaagtagacacctttaccactaggcttgccaggtcagtcctcctgcccaacctattcacattgcttccttctaaatccagatcctggggcatctgcctgcactctagctgcaagacagactggcaggagtatgagtatcatgatttcaccaagaagatggaactctcatgtgggaaattatcaaaatataaggaggatatctaagatgctatagccacagtgatagttgtccactagttagattatctttaccatcttaacatcgaacattttatataagatgcttatgaccaattacatttattttcccatcaccacctcctaattatacttactgaacgggcacattttttggggggactgctagaaagtccatccagttgtccatgttcacccagaaatcccgtcacttggtccaagaaagaagatacatctaactggtgccattctactagcttctgacctaaggattaaaaaccaagatctataaataaatataatatctagaatccttctgaacattctccaggatctataaatataatacctagaatccttctgaacactctcattaagtatctctttcagcatatgcatagattaaaaacctggatctataaaggtaatatctagaatctttctgaacattcttattaagtatctctttcagcatatgcatagattaaaaaccaggatctataaaggtaatatctagaatctttctgaacattctcattatctctttcagcatatgcatacattaaaaaccaggatctgtaaatataatatctaggatctttctgaacattctcattaagtatctctttcagcacatgcataaagtgtactgtaaagacatatcctctccaccagcttatgctacatagtgtcttcataacctagaagtcacatcaattatactcacctaacagattcccacccgtaatgatagggcaactatcttatctgctgctatcacttactgccatttaggaagaagagattcagacaaagcaatatctatataaaacaccatcaattaataaaaccagctccaccctctgcttctcaggtgggattacaactagtatctgggcaatcttaatattttaatgataaaaaaaacttttgtcttgttttgtttttttgagatggagtctcactctgttgcccaggctggagtgcagtggcgcgatctcggctcactgcaacctccacctcccgggttcaggccattctcctgcctcagcctcccaagcagctgggactacaggtgcccgccaccatgcccggctaattttttttgtatttttagtagagatggggtttcaccgtgttagccaggatggtctggatcgcctgacctcatgatccgcccacctcggcctcccaaagtgctgggattacaggcatgagccaccacgcccagctggtaaaaaaacttttaaaaaatcccttaaaaaaggtaagatgaacatatcagttattcttcaaaagaacagaactgcacaaacataaaatactaccatctcccaatgttgccagaaaaagatgtcctaaatacatacatcaatagatgtttaaataattataaagggaaaaaaacgaaaccttcacctaaattactgcaattctgaaaacagatccagtcaaatattaaagatcaatcatttaggtaactgaaagacaagtaataggttaaaagctgcgtgctgatataaatcttacctgtccgtgggtccaatatggaaacataggggaaatcccctaacttataaaactgtatgtatctctgaccttcctcactgtcatgataaacctgttaaatcattgatataaaaaaaaaagtcagcctctaagaaaagaaccaactataaccttcttatacaccaacatcaattagctctccaaatatacctccggcctatgtattaagatctcactcctacactaaaaagaaaataaatctggtttgaactccttcaacttcccacttccagcactctctggaaatttaccataaacatattgacccattcctcctcctttcccagttcagatgaggtattattcttcctgctcaagttatctgtcaactatgtcattcataactctcaaccatatacatcttaataaatcacaatatattaagattatgggccaggcatggtggctcacgcctgtaatcccagcactttaggaggccgaggcgagtggatcacaaggtcaggagattgagaccatcctggccaacatggtgaaaccccgtctctactaaaatacaaaaattagccgggcctggtgacaggcgcttgtagtcccagctactcgggagactgaagcaggggaatcgcttgaacccgggaggcagagactgcagtgagctgagatcgtgccactgcactcctgcccagcgacaatgcaagacttgtctcaaaaaaaaaaaaaaaaaaaaaagattatggctccacatggtggctcgcacctataaccctagcactttgtagggcagaggcagaggacagcttgaggccaggagtttgagaccagcctgggcatctccacgagaagtttttttgtttttttttgtttgtttgtttgtttttaaattagccaggtttaatggtgtgcacctatagtcccagcaactcaggagactgaggtgggaagatcccttgagcctataggggttagagcctgcagtgagctatgactgcaccactgtgttccggcctgggtgacagagcaagaccctgtccatttatttaaaaaaaaaaagaaaaaagaaaagaaaagaaagaaagaaaaaaagattataagctcaagagtccagcacagtgctaagcaaagagctgctcgatcaatatttgttgaataaaatacaaggaattttaccattaaagttacattaaatttaggggcctgtaaaatataaacaggcaaattaataacattaatagcatatcttacagtaggggaaaaaattaagctccttcataagtttttattttctataacttttcacaaaataaaaaataaaaaaattgagccggcacggtgattcatgcctataatcccagcactttgggaagccaagggaagcagatggcttgggcccaggagttcgagacgagcctgggcaatatggcaggaccccatctctacaaaaaaaaaaaaaaaaaaaaaattatatgggcatagtggtgcatgtttgtggtcccaactactcaagaaactgaggtggaaggatcatttgagcccaggaggtcaaggctgagccatgttcatgccactgcattgcagcctgggtgacagagcaaaaccctgtctcacagtgggggaaaaatgatacaaggtctgtaaccttatctcattagctgggaagactaaagtgacatgtctaagaacacagagttaaaaagtatcaaactcaagctaaaatctaagtcttagccaaatgcttccaattacctcaagatcttctatacctgcactgtctaatacagcaaccactacccacaagtggctactgaagcacctgaaatcttgctactccaaatggagaaggggtgtaagtataaaatacaaaccatatcttgaagactcaacaccaaataaatgcagatcatctcattatttttgtattagttatatagatatattgatttaaccaaatacattattacagttaatttcatctattttgattaatcttttttaatgtggctactggaaaaatttaaattatgtgtacagcttacaatatatttctactgaacagtacagtttgtttgttttgttttgtttgagatggagtctagctctattgttcaggctggagtgtaatggtgtgatcttggctcactgcagtctccgctacccgggttcaagtgattctcctgcctcagcctcccgagtagctgggattacaggtgcctgctgccacacctggctgattttttgtatttttaggagagacagggtttcaccatgttggccaggctggtctcaaactcctgacctcaggtgatccgccggcctcagcctcccaaagtgctgggattataggcgtgagctactgcccccagccggctttacctttttttaaatgtcttaattcattataacccaattcctttccctcaacaacccacactacaaaagtaaaattctacaaaacttctgattaactctccttctcacctgccagaaaatgaaatgttcccggataatattcttcacagcttcgttgctccacacatcgcggttgaggcactgacatgcaaagtcttgaacattttgaatgtttatcatcagccacttattttgcatctggccacactctttggcctgcaagagtaaagttacacatttgttagaaataatttctacttagtgacagatgtttccgtagttgttcagaggttgttgtctttcattaaaaatactaagtttttgccagatacgacatctagagttttcagcatttatacattctatatatttacttcgcatatgcatttatagctatactgtccatttcaagcactgctcaaatttaaatgaactcatttctcttttatccagttatttgttataatagctgattctctctctctctctctctctctctcctttctttctttctttcttttttttttttttttgagacagagtctaactctattgcccaggctagagtacagtggggcagtctcggctcactgcaacctccacctcctgagttcaagtgattctcccgccgcagcctcccaagtagttgggattaaaggcgtgccccaacacgcctggctgatttttgtatttttagtagagatggggtatcaacatgttggccaggctggtctcgaacttctgacctcaaatgacccgtccaccttggcctcccaaagtgctggaattacaggtgtgactcatcatgaccggtaatggctgaatttttaatgtatgtttaaacatctttacctgaaaaggattcaacaaacttaagatcaacaagtcacgtaattttattctcttgcaacctccatcaacaattttttttttttttgagacgagctttgctcttgttgcctaagtcggagaacaatggcacgatctcggctcactacaacctccacctactaggttcaagtgattcttctgccttagcctaccgagtagctgggattacaggtgtgtgccaccatgcctgactaattttttatatatttttagtaaagagacggggtttcaccatgttggccaggctggtctcaaactcctgacctcaggtgacgcacccatctcagcctcccaaagtgctgggattataggcgtgagccaccgcgcccagccaattatacttctttttaatgaatgcaattggtgtgtatattttactttgttttcttcaacatcatttctggaacatttttaaacatcatattaatctcagttattaggcatatatgctgttttggagaatcaccctaaacattttagtaaaaactgctgagagttttttctcttaagagttgtcttcctaggagtagattccaaaaattgggattacaaggtcaaagaatgtttgagaatgatccccaaacaactctacgattcgtacaacagatatcgatacatcaatcgttagtgcgtactttttgcctgtcagtcccttgtcagcataaagacccatgaaatgctgctgagtggaaaacaatggcagaaaagcaaataagcaaatgctgcctcaaatctttgcctaggaaagaacagtgacacgaaaccacagttttggaataaatttatcctagaacagtattcttttccaaatcagtgtgacatgggaaaatcttaagaatcaatgaatttggtgtaataacaatccaagaacatactggacatcattttgtgggtactgaaaaatgtgagactgagaatatcttctgttttaagaaggtctacatcatctcacaaatagctttttttttgtatgaatcccccagaataaattattttctttttttgttgtttatattttttgtagagacaggggtttcactatgttagccaggctggtttggaacacctagcctcaaatgatcctcctgccctggcctccaaaagtcttgggattacaggtgtcagtcaccccactcagccccagaataaattatcttctaatatttgcttactgattccatgggtgaaaacccaaggtctaaaaagaaatatcctcatattgagccaggaagccgcatttaactggtcaaaggcttattttaaaatatacaaatataataattccttgcttataggaagtaatatttccatttacttccttataggacaaagatttaaaaagtgaatgataaatgaataattaagctgctttaactacagaaacagtatttgaaaataaacggaaaaatgaccatacgttctagagatagactagagcgcacatattcctacagcagggtaaatttacataagtctgccccaaaaacaatgacaagaaaaaaatgtacaaaactgaaaatgaataaaagtccagagtttaaaatggaagagtcacttttttttttcgcttttaaaaatttgtttactcacattcatgctttcattatctcagatttattcattcaacaaatactgagtacctatcatgtttcaggtacagttatagatattaaagtaatagcagttctaaaatataaaaatctttgcctttgtgaagcttccaatgggggagaaacctaatactagcaaaagaaacttggaaatgatactaaccacattgaagatattgttaaaaaattgttactgctaaaaggaagggtgcaaagacacaattttcaaacaaaacaacaatattgggagggaataaaagagtcttgaataggccaggtgcagtggctcacacctgcaatcccagcactttgggaggccgaggtgggtggatcacctgaggtcaggagttcaagaccagcctggtcaacatggtgaaaccccatctctactaaaaacacaaaattagccaggcatggtggtgggcacctgtaatcccagctactcaggagactgaggcagaattgcttgaacctgggtggcagaggttgcagtgagccaagatcgtgccattgcactccagcctgggcaacagagtgaggggaggggaggggaggggagggggaggggagggggggagggggagggggagggggaggggaagggaagaaggaaggaaggaaagaaagaaagaaaaaaaggaaggagggaaggaaggaagggagggagggagggagggaggaaggaaggaaggaaggaaggaaggaaggaaggaagggaaaggaaaggaaaaaggagaggaagaaagaagagtcttgaataagtctagagatctcatgtacaacatgaggactatacttaataatatcgtattatacattgaaaatgtgctgagagcagattattaggtgctcttaccacacacacacacacacacacacacacacacacacacacacacgtaaaaagacaattatggaaggtaaggacaggttaatttgcttgactgtagtaatcattttactatgtatatccaatcttcatgttatacatcttaaatatgtacagtagtctggagcagtggctcacacctataatcccactgccttgggaggccaagacaggaggattgcttaaggcaaggagttcgagaccaccctgggcaacacagcaagaccccatctctaaaaagatttaaaataattgaatatatgcaatttaaaaagagagagtcttaaaaataatctaagtataccaattatgtgaatcaaggactggaggtgagagtgggccatgagaaaaataatctcctcatggaagattatcattgaagaagattactggaatccttggaatctattaggttgttctgaatcaacatttcaaagccattataatggagaccccagagtaaaacagcgggagactaacgtctgtcccagtaccagccagatcaggaaggcatgataaaaaaggatttaggcctggcatggtggctcatgcctgtaatcccagcactttgggaggccgatgtgggctgatcatttgagcccaagagttcaagaccagcctggtcaacatggcgaaaccccatctctactaacgatactaaaattagacgagcgtggtggcgcatgcctgtaatcccatctacttgggtagctgaggtacaagtattgcttgaatctgggaggcagaggttgcagtgagctgggatcatgccactgcactccagcctaggcaacagggcaagactgcctcaaaaaaagaaagaaaaagaaaatgaaggatttgaacaaatttaatatgtttcagtaagtatatatgcataaagtcgagaagaaaatatattaaaatatacacagtacttttttatggaaatggaaattacaattttatttttccttgttcattttctaaatttcaatgatttgtctaatttgaataaaactaaatgtaaacaatataaagtttaatcagaaaaatgttatatattgccaggggcagtggctcttgcctgtaatcacagcactttgggaggccgaggtgggtggatcacctgaggtcaggagttcgagaccagcttgaccaatatggtggtgaaacctcgtctctactaaaatttaaaaaattagccaggcgtggtggtgtgtacctatagtcccagctactcgggagggtgagacaggagaatcgcttgaacccaggaggcggaggttgcagtgagctgagatcgcgccactgcactctggcctgggcgacagagcgagactctgtctcaaaaaaaaaaaaaaaaaaaaaaagaaaagaaaagaaaaaggaaaaattagttactaactaggctcttcttcacattttcggctacatattttcacttgcatttatactaaatacttatgaaattaacaaaatattcttagtaattagagctaggtgcatgtgtaatgggataccaatttaaaatgtgggttttttttcctcatgaaataagaaatattggccgggtccagtggctcacactggtaatctcagaactctgggaggccaaggctggttaatcactggagctcaggagttcaagaccaacctgggcaacgtggcaaaacctcatctctacaaaaaatacaaaatttagccaggcatggtggcacacgcccataatccaggctacctgggggactaagttgggcagatcacttgaacccaggaagttggggctgcagtgagccgagatcgtgccactgcactccagcctgggtgacagagtgagactctgtctcaaaaaaaaaaaaaaaaaggaagaaatattaccgaaattgttctgattctttctgtacaatattccttctggcataatcatgatttcatgaaggctaattaaactgctttagaccccgtggacacacaacagtcaagaaaatgaagtccctgtgttcatacagcttacagcatggtggggaaagaggaaaacgtaggaaacattcccttgcccaggtcagaccatttggcctcagtgctctgctcactcagctggtcttcttgacggtaccagctctttccaacatcagtatgctcacactgtattttccctcagacctccccatcgttcgcattccctcgcttcactaaggtttctattcatatctcatcctttcagaaatcttccctaatcttcctaatacagtcctttctcttcacaattataaacatatgtggaacctacgaaatcaatctggctttcaatttggctgtaagaagaaactgaatttggcaacacggacacatctacttgcaaaggacactagaaatttccagatgcttaactcaattcagaccacacacatcaaatggccctgaacaaaatacagcccccctctctccttcccttattgtattttattctcctttttttttcttttgagacagggtctcactgtgttgctcagggtggagggcaatggcaccaccacagctcactgcagcctcaacctcctgggctcaagcgatcctcctaccccagcctcctgagtagctgctggggaccacaggtgtgcaccaccacgtccagctaattttttcgactttttgtagagacagggttccaccatattgcccaggctggtctcgaactcctgggctcaagtgatctactcccttcagcctcccaccaaagtgctgggattacaggcatgagccactgcatccagctacattttattctttctccaagcaactactataacttgaaatgaatgtcacactctctctctccatcaaagacaaacatatgtattatattcactgttattatatatatgtgtttgtgtgtgtttgttttacgttatttgtttatagtctgtttctcctactagattataaacgctacaatggcaaggattttatataatttaccactatctccctgtggcagaaactgcttataggtaccaaataacccattctccccttgtccctcttacttatagaacctccagtttttaactaagcatctggatttcctagtgtcccttgcaaatgggtgtagccatgctgccaagttatagtagatggaatgtagacagaagtgctgggtacaacttctaggttgttcccttcaagggaaatttgtacccttatcagctcctccctcttccatgctgtttatttttttttaagtgaaagcaagtttattaagaaagtaaaggaataaagtatggctattccataggcagagcagcccaagggctgctggttgccaatttttatgtttatttcttgcttatatgctaatcaaggagtggattacttatgagttttccaggaaaaggttgggcagttccgagaactgagggctcctcctcctttttagacgatacagggcaacttcctgatgttgccatggcatttgtaaactgccactgcactggtgggagtggagcagtgaggatgaccaggtcaccctcatcaccatgttggttttgggggattttagccagcttctttccatgttggttttggggggttttagccagcttctttccatgttggttttggtggattttagccagcttctttccatgttggttttgggggattttagccagcttctttccatgttggttttggggggttttagccagcttctttccatgttggttttggggggttttagccagcttctttccatgttggttttggggggttttagccagcttctttccatgttggttttgggggattttagccagcttctttccatgttggttttgggggattttagccagcttctttccatgttggttttggggggttttagccagcttctttccatgttggttttgggggattttagccacagcttctttccatgttggttttggggggttttagccagcttctttccatgttggttttggggggttttagccagcttctttccatgttggttttggggggttttagccagcttctttccatgttggttttgggggatcttagccagcttctttccatgttggttttgggggattttagcttctttactgcaacatgtttcatcagcaaggccttcatgaccagtttcttgtgctgacctcctatctcatcccatgacttagaatgtctaaccttctgggaatgcagcccactaggtctcagccttattttaccgagcccctattcaaaatggagttgctctgttttaaatgcttctgacatttcctccctcccttttacaagagaacccttaatcctaagggttgtagagggaaaaagattcaacttccgtaacttcttcatgcttaatagggacgatggtattcctgtctattagatctcttgcattcagagtagagaggacctcagtctgaaagcatctgtatggcgagcgccattcctaactcttgagtcccaacagaaggtggtatccttcagccaactggtgctcacagatgattttcctttgggttgggggtatcttcggtatcatcccttctgtgattcgccagaaagatgttactgggccccaccacttaaccaaagttagcctttgggttgggggtttcctcagtattgtcccttctgtggtcgccagaatgatgttactggaaaggggtccggatccagatcccaagagagggttcttggatctagtgcaggaaagaattcagggcgagcctatagagtaaagtgaaagcaggtttatcaagaatgtgaaggtcatgcctgtaatcccagcactttgggaggccaaggcgggtggatcacgaggtcaggagatcgagaccatcctggctaccagggtgaaaccacatctctattaaaaaatacaaaaaatcagctgagcgtggtggcgggcgcctgtggtcccagctactcaggaggctgaggaaggagaatggagtgaacctaggaggtggagcgtgcagtgaggcaagatagcgccactgcagtccagcagtccagcctgggcgaaagagcgagatttcatctcaaaaaaaaaaaaaaagaatgtgaaggaatgaagaacagccactccataggcagaggagccttccatgctgtttagtaagcaaacatggtggtaaggcaacttgaatcatgcagacaagggcaagcaagacctaggggatggcagaacaagacagaaaaaaattctgcaactctaataactttacagagctaatcatcctaatagcctggacttccatcttgcttaagctactgtttgtttgtggtggggtgttccaagatggccaaataggagcagctgcagtctgcagctcccagcatgatcaatgcagaagacggacgatttctgcatttccaactgaggtacctggttcatctcactgggactgggtggagagcgggtgcagcccacggagggcgagctgaagcagggcagcgtgccgcctcacctgggaagtgcaaggggtcggggaaatcatttccctttcctagccaagggaagccgtgacagactatctggaaaaacggggcactcccacccaaataccgcatttttcccaaggtcttagcaactggcaggcaaggtgattctctctcgtacctggcttggcaggtcccacgcccatggagccttgctcactgccagcgcagcagtcagagattgatctgtgaggtggcagcctggctgagggaggggcgtccgccattgctgaggcttgaataggtaaacaaagcggctgggaagcttgaactgggcagagcccaccacagctcaacaaggcctactgcccctaaactccacctctgtgggcagggcatagctgaacaaaaggcagcagacaacttctgcagacttaaacgtccctgtctaacagctctgaagagagcagtggttctcccagcatggtgtttgagctctgagaacggacagatggcctcctcaagtgggtccctgactcccgtgtagcctaactgggagacatctcccagtaggggccgacagacacctcatacaggcggctgcccctctgggacgaagcttccagaggaaggctcaggcagcaatatttgcagttctgcagcttctgctggtgatacccaggcaaacagggtctggagtgaaactcctgcaaactccaacagacctacagctgagggacctgactgttagaaggaaaactaacaaacaaaaaggaatagcatctacatcaacaaaaaggtcatctacaccaaaatcccatctgtaggtcaccaacatcaaagaccaaaggtagataaaaccgcaaagatggggagaaaccagagcagaaaagatgaaaattctaaaaatcagagcgcctcttctcctccaaaggatcgcaactccttgccagcaacggaacaacgctggatggagaatgactttgacaagttgacagaagtagtcttcagaaggtcggtaataacaaacttctccaagctaaaggaggatgttcgaacccatcgcaaggaagctaaacaccttgaaaaaagattagatgaattgctaactagaataaacagtgtagagaagaacttaaatgacctgatggagctgaaaaccacagcacgagaacttcgtgacgcttgcataagcttcaatagctgatttgatcaagtggaaggaagggtatcagtgattgaagatcaaattaatgaaataaagtgagaagacaaggttagagaaaaaagagtaaaaagaaacaaacaaagcctccaagaaatatgagactatgtgaaaagaccaaatctacgtttgattggtgtacctgaaagtgacggggagaatggaaccaagatggaaaacactcttcaggacattatccaggagaacttccccaacctagcaaggcaggccaacattcaaattcaggaaatacagagaacaccacaaagatactcctcaagaaaagcaaccccaagacacataattgtcagattcaccaaggttgaaatgaagggaaaagtgttaagggcagccagagagaaaggtcaagttacccacaaagggaagcccatcagactaacagcagatatctctgcagaaaccctacaagccagaagagtgggggccaatattcgacattcttaaagaaaagaattttcaacccagaatttcatatccagccaaactaagcttcataagtgaaggagaaataaaatactttacagacaagaaaatgctgagacattttgtcaccaccaggcctgccttacaagagctcctgaaggaagcactaaacatggaaagaaacaaccggtgccagccactgcaaaaacatgccaaattgtaaagaccattgatgctaggaagaaactgcatcaactaatgggcaaaataaccagctaacatcataatgacaggatcaaattcacacacaataatattaaccttaaatgtaaatgggctaaatgccccaattaaaagacacagactggcaaattggataaagagttaagacccatcagtgtgctgtattcaggagacccatctcacatgcaaagacacacataggctcaaaataaagggatggaggaagatctaccaagcaaatggaaagcaaaaaaaatgcaggggttggccgggcacaatggctcatgcctgtaatcccagcactttgggaggccaaggcaggcagatcacgaggtcaggagatcgagaccatcctggctaacacggtgaaaccccgtctctactaaaaatacaaaaaaattagctgggcgtggtggcaggcgcctatagtcccagctactcgagaggctgaggtgggagaatggcatgaacccaggaggcagagcttgcagtgagcccagatcgcaccactgcactccagcctgggccacaaagcaagactccatctccaaaaaaaaaaaaagaaaaagaaaaaaacacaggggttgcaatcctagtctctgataaaacagactttaaaccaacaaaaatcaaaagagacaaagaaggccattacatattggtaaaggggtcaattcaacaagaagagctaactatcctaaatatatatgcatccaaattcaaaaagcaagtccttagagacctacagagaagagacttagactcccacacaataataatgggagaatttaacaccccactgtcaatattagacagatcaatgagacagaaagttaacaaggatatccaggacctgaactcagctctgcaacaagcagacctaatagacatctacagaactctccaccccaaatcaacagaatatacatttcttctcagcaccacatcacacttattccaaaactgaccacatagttggaagtaaagcactcctcagcaaatgcaaaagaacagaaatcacaacaaactgtctctcagaccacagtgcaatcaaattagaactcaggattaagaaactcattcaaaactgcacaactacatggaaactgaacaacctgctcctgaatgactactgggcacataacgaaatgaaggcagaaataatgatgttctttgaaaccaatgagaacaaagacacaacgtaacagaatctctgggacacacttaaagcagtgtgtagagggaaactcatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacataaaaaacccttcaaaaaatcaatgaatccaagagctggttttttgaaaagatcaacaaaattgatagaccactagcaagactaataaagaagaaaagagagaagaatcaaatagacgcaataaaaaatgatcaaggtgatatcaccactgatcccacagaaatacaaactaccaccagagaatactataaacacctctatgcaaataaactagaaaatctagaagaaatgggcaaattcctggacacatacaccctcccaagactaaaccaggaagaagttgaatctctgaacagaccaataacaggctctgaaattgaggcaataattaacagcctaacaaccaaaaaaagtccaggaccagacggattcacagccaaattctaccagaggtacaaagaggagctggtaccattccttctgaaactattccaatcaacagaaaaaaagggaatcctccctaactcattttatgaggccaacatcatcctgataccaaagcctggcagagacacaacaaaaaaggagaattttagaccaatatccctgatgaacattgatgcgaaaatcctcaataaaatactggcaaaccgaatccagcagcacatgaaaaagcttatccaccatgatcaagtcggcttcatccctgggatgcaaggttggttcaacatatgcaaatcaataaacataatccatcatatcaacagaaccaacgacaaaaaccacatgattatctcaatagatgcagaaaagaccttcaacaaaattcaacagcccttcacgctaaaaattctcaataaactaggtattgatggaacgtatctcaaaataataagagatatttatggcaaacccacagccaataccatactgaatgggcaaaaactggaagcattccctttgaaaaccggcacaagacaaggatgccctctctcaccactcctattcaacatactgttggaagttctggccagggcaatcaggcaagagaaataaataaagggtattcaattaggaaatgaggaagtcgctctccctctccctctcccctttgcacggtctccctctgatgctgagccgaggctggactgtactgccgccatctcgactcactgcaacctccctgcctgattctcctgcctcagcctgccgagtgcctgggattgcaggcgcgcgccaccacgcctgactggttttcgtattttttggtggagacggggtttcgccgtgttggccgggctggtctccagctcctgaccgtgagtgatctgccagcctcggcctcccgaggtgccgggattgcagacggagtctcgctcagtcagtgctcaatgttgcccaggctgaagtgcagtggcgtgatctcggctcgctacaacctccacctcccagccgcctgccttggcctcccaaagtgccgagattgcagcctctgcccggccgccacccagtctaggaagtgaggagcgcctctgcccggccgtcatcccatctaggaagtgaggagcgtctctgcccagccacccatcgtctgggatgtggggagtgcctctgccccgccaccccatctgagatgtgaagagcgcctcggcccggcagtgaccccgtctgggaactgagaagtgtctctgccccgccgccacccactctgggaggtgaggagcctctctgaccggccgccccctctgagaagtgaggagcccctctgcccagcagccgccccgtctgggaagtgaggagcccctacgcccggcagccgcccatcagggaggtggggggcagcccccacccggccagccgccccgtctgggaagtggggggggtgggggcgcctctgcccggccgccccgtctgggaagtgaggagcccctctgcccggccgccaccccatctgggaggtgtacccaatagctcattgagaacgggccatgatgacgatggtggttttgtcgaatagaagggggggaaatgtagggaaaggaaggagagatcggattgttactgtgtctgcgtagaaagaggtggacataggagactccattttgttctgtactaagagaaattcttctgccttgggatgctgtttatctatgaccttacccccaaccccatgctctctgaaacatgtgctgtgtccactaagggttaaatggatgaagggcggtgcaagatgtgctttgttaaacagatgcttgaaggcagcatactcgttaagcgtcatcaccactccctaatctcaagtacccagggacacaaacactgcggaaggcagcagggccctctgcgtaggaaaaccagagacctttgttcacatgtttatctgctgaccttccctccactactgtcctatgaccctgccacatccccctctccgagaaacacccaagaatgattaataaacactaaaaaaaaaaaaaaaaaaaaaaaaaggaaatgaggaagtcaaattgtccctgtttgcagatgacatgattgtatatttagaaaaccccatcgtctcagcccaaaacctccttaagctgataagcaacttcagcaaagtcttaggatacaaaatcaatgtgcaaaaatcacaagcattcctatacaccattaacagacaaagagccaaatcatgagtgaactcccattcacaattgctacaaagagaataaaatacctagaaatccaacttacaagggatgtgaaggacctctttaaggagaactactaaccactgctcaacgaaataaaagaggacacaaacaaatggaagaacattccatgctcatggataggaagaatcaatacctgaaaatggccatattgcccaaagtaatttctagattcaatgccaaccccatgaagttaccaacgactttcttcacagaactggaaaaaactactttaaagttcgtatggaacctaaaaagagcccacattgccaagacaatcctaagcaaaaagaacaaagctggaggcatcatgctacctgacttcaaactatactacaaggctacagtaaccaaaacagcatggtactggtaccgaaacaaatatatactatatctgtttcaaactatactacaaggctacagtaaccaaaacagcatggtgctggtaccaaaacagatatacagaccaatggaacagaacagaggcctcagaaataacaccacacatctacaaccatctgatctttgacaaacctgacaaaaacaagaaatggggaaaggattccctatttaataaatggtgctgggaaaactggctagccataggtagaaagctgaaactggatcccttccttacaccttatacaaaaattaattcaagatggattaaagacttaaatgttagacctaaaaccataaaaaccctagaagaaaacctaggcaataccattcaggacacaggcatgggcaaagacttcacaactaaaacaccaatagcaatggcaacaaaagccaaaatagacaaatgggatctaattaaactaaagagcttctgcatggcaaaagaaactaccattagagtgaacaggcaacctacagaatgggaaaaaatttttgcaatctacccatctgacaaaaggctaatatccagaatctacaaagaactcaaacaaatttacaagaaaaaaacaaacaaccccatcgaaaagtgggcaaaggatatgaacagacacttctcaaaagaagacatctatctatgcagcgaacagacacatgaaaaaatgctcatcatcactggtcatcagagaaatacaaatcaaaaccacaatgagataccatctcatgccagttagaatggcaatcattaaaaagtcaggaaacaacagatgctggagaggatgtagagaaatagggacgcttttacactgttggtgggagtgtaaattagttcaaccattgtggaagacagtgtggcgattcctcaaggatctagaactagaattaccatttgacccagcaatcctattactgggtatatacccaaaggattataaatcatgctgctataaagacacatgcacacgtatgtttattgcagcactattcacaacagcaaagacttggaaccaacccaaatgtccatcaatgatagactgcattaagaaaatgtggcacatatacaacatggaatactatgcagccataaaaaaggatgagttcatgtcctttgcagggacatggatgaagctggaaaccatcattctcagccaactatcacaaggacagaaaaccaaacaccacatgatctcactcacaggtgggtattgaacaatgagatcacttggatacagggcagggaacatcacacactggggcctgtcgggggctggggggctggggggctgggggagggatagcattaggagaaatacctaatgtaaatgagttgatgggtgcagcaaaccaacatggcacatgtatacctatgtatcaaacctgcatgttatgcgcatgtaccctagaacttaaagtataataaaagaaataaataagctactgtttgttttttttttttccagtctctctcacatgcagtcaaacccttactcttgatcacctagaactaggtcctgcaacacaaggcctcaataaatatgtattgagtgaacaagtgaattaatcagtctctctcatctggttagcatgagccagaaagaatccttgaacatgacctacctctagttacactagcttctaagcctgtaaaactgtggctcacatttacatctaatatgaggaacaaacctatgggccctccttggtcagccaaagagtatccctctaatttttaacatttatctttctaaacttcaatgacttaattttgcttgttatctccctaattgttataaaactaatacatgtatcattaaccataatgaaatacctgcttttggaagggaatatttatttcatttaaagtcttgcagatggttaagtataatattatcagtgaaaaaaaaaatggactgctgtaaacacaggccatgaaatacaaggcaaaaaaggtgatataacttaaatttcaggggacaacatcaaaagagattcgtattttcccttaatgaccaagcagaaaagtaactgctttttcactccaaagtgaccaaactaaatcaagcttagttactgcattacgtcctagagcaactcataagctaataaaaatagaacacgtgccaaaacaaactaagatccttttctgcctttaatattgctgctattctctctctcaatggctgtagtatcaccagaatactagaaaggataggcagctgccatgttgagaccatgaaggaaagatgaagaaaactgaggagacatctaacctgacatctttgagcttatgaatgaacagcaataatttcttcaactctaggcttattactgacaaaaagaaagcattgtttggtcaaattatcatcatttgggttttctgttacatgcagccaaaccactttcaaggttttctgattcagaaaattgaaactggagagcacgctgatatggtttggaaatttgtcccctccaaatctcacactgaaatgtaatccccagtgttgggggtggggcctcgtaggtggtgtttgggtcatgggggcagacccctagtgaatggcttgaccccttgctcctcgcaccatgtgctacaccggcttcccctttgccttctgccatgactgcaagcttcctgaggcctcaccagaagcagatgtcagcacaatgctttctatacagcctgtagaaacgttgagtcaaaatatacctttttctttataaattgcccagtctcagggattcctttctagcaatgcaagcaaactaacacacaagcttacattgaaattccttctcctaaatacttcatgtatgacagtgtaaaagtatatcaaaggacacatttaaaaaaaaataatcataacatattcaaatatgcagctgatatacatcggttgtttattttaagaaatggggtttcagctcatgcctgtaatcccagcactttgggaaccaaggcagaaggatcacttgacaccaggaatttgagaccagcctggggaacacagcaagaccccctctccacaaaatatttttaaaattggccaggtgtggtagtgggtgtctgtagccctacttatttgggaggttaagaccaggggatcaattgagaccataagttggaggctgcagtgagccatgattttgccactgcactccatcccaggtgacagaatgagaacctgtctcaaaaaaaaaagacaaagaaaagggaaagatagggtctcactatgttgcccaggctggagtgcagtggttttcataggcatgatcatcacacaccacagcctcaaactcctgaactcaagggatcctcccacctcagcctcccaagtagtagttagtttggggcacctgttgggcttgatacacatcattcttgcagttattctttggcctacagggtcctaacaggtaagacttaactgaaggctgggcgcggtggctcacgcctgtaatcccagcactgtgggaggctgaggtgggcagatcatgaggtcaggagtttgagaccagcctggccaatatggtgaaaccccgtctctactaaaaatacaaaaaattagccaggcgtggtggtgcgcacctgttttcccagctactcaggaggctgaggcaggagaattacttgaacctgggaggcggaggttgcagtgagctgagatcgtgccactgcactccggcgagactccatctcaaggaaaaaaaaaaaaaaaagactcaactgaaatgtaactgatttacatctatggaaatgctattgtaattcaaaagagcattaacatgttaatcaacacgaaaaggcaagctgtttgaacacctcaacagaagagtatctaaaatctttactaaactccttcatttaacatatgtgttcctcctaatgcaagagaatgggtcccaaggattattaaaaagaatgatctttcctctgccctaagtaagtctgtaagttagcatacaaccaagtaaacatactctggaaagtttttgtttgggtttagtcacgataaaaccaagaagaactgagggtgaatgtgttctccaattagagatattcttttcaaacacattacgatccgcacagaaatatagacaaaagacacctatcaacaatttacaaatggctaacaaaccacacacactattctcagtagtagtcaaagatatatgaacaagtgagatattttaaaaagctatcaaaatggcaaagattctaaaatgacaccgcacaaggctaataaaaggatttcatcaatctcatatactgctggtagaaatatatttcatatattgctggtagaaatataaatcaatgtaacctttaggcatatcatgtagatatacttattataatgccaattccctatacactgacaatggttttttgttcttataaaaataaaaaatgccactgaaggccaggtgcagtggctcacacctataatccaagcagtttgggaggctgaggcaagaggattgcttgaacctaggcattcgagaccagcctgggcgacacagtgagaccctgtctctaccaaaaaaatttttttaattagctgagtgtggtggcacatgcctatagccctagctactcgggaagctgaggtaggaggatcccttgagcccaagagttcaaggctgcagtgagctatgattgtgtcactgcagtccagcctggacgacagagcgagacctgctctaaaacaagtaattttttaaaaaaaggcattgaaaatgcaaaaggattcatagttaaggcactgactctccaacaacttactgtttcaaagctgcctttatgcatcaaatcaatgggtggccggaatagatctgcaagggtagttaatttcttatcgatagctcctccatttcttaattcttgttcttgccgaactataatacagaaggatgaaagtttcagttagccataatcatgaatcacactgaaaaaaaaaaaaaaaaaaacacaaacttctgtcaattgaaggaattgctgtcaatatgcttgacctcaaatacaaagatctaatgttgactctgaaaaaaaaaaatgcaaagggagataagaggaatcttaagacttggtggtattccctatcccaaggatacaaagaaaattaactgaaaatattcacttaatcaaagtaacctcttcacatattcagaaactaactgtaacatgggagaggctgagtgcggtggctcatgtctataattctagaactttggatggccgaggtcagcagatcacctgaggtcaggagtttgagatcagcctggccaagatggtgaaaccccgtttcaactaaaaatacaaaaaaaaaaagccgggcatggtggagcatgcctgtaatcccagctactcgggaggctgaggcaggagaatagcctgaaccctggaggcagaggttgcagtgagcagagatcgcgccactgcactccagcctgggcaacagagtgtgagactccatctcaaaaaaaaaaaattagccaggtgtagtggcgcatgcctgtagtcccagcactatgggaggctgagatgtgcggatcacctgaggtcaggagttcaaggccagcctgggcaacatggtgaaacctcatctctactaaaaatacaaaacttagccgggtgtggtggcacaagcctgtagtcccagctacttgggaggctgaggcaggagaatcgtttgaacctgagaggtgaaggttgcagtaagctgagatcatgccactgcactccagcctgggtgacagagcgagactccatctcaaaaataaatagtaataataaaaaaaagattatgacagtagagatgatgaccactgttgtcaccttccactggaaggacacaggattccctagatgacttgagtcagtttaggttccccatcaattctctccaaagtcacaagacctatctgtgcctcaatgaactcattctaaataaactacaaaatcaagcatggtccaagggtttctcatatatcctaacctaactgtcctttctttaggattccattgctaaatcaatactaaatcctctaaaagcataagaccaagattctcattctaatttattacacaaaaatatttcaaataactgtagccaaaatattaatagtggctgctttgggtggcatggcttttcctcctatttttcaatctcttataataaccattttcattatatattcctttcattgacagaagtcaggatcctgagggaaatcagtttattttattatagtaagcattttaagtgtttattcacaagcgaattaagtttatcaattaccatatttcctacattatctccatctcctttactatttttctataaccaaataggttagaatttggaacaatttagctcaggggagaattaatcacattctggatccataatttcactttttaaagaaggtgaaaacttaaaagtaattgggcctaatagtaatcatctttgtctttttaataggaagagaagagggagatgataaactggtccatagatacctactagtttcagtctgaaaatcccggaaaccatcaaaaattgaacgtgcaggccgtcgtcttttaggagctttggggagaaaaaatagaattgaaaattttttaaattaattttgaaacaattctaaaaatgtccttatctaaaagtatttttttaataaaacatatgaaacccttcacgaactgcatgtcacccttgcacaggggccgtgctaatctctgtctcgttccaattttagtaaatgtgctgccgcagcgagcacagtatttcttgttttaaaacactcaagattcatatggtgccttccctcaaaaaataaaaaagtttaaaaactttcaaatcattcatgtataattaatccaaacatcttccatccagtcatcttgtattacaaatgagaaaattcaggcccagttacaatagacttaatcaaacttgtgtaaaaagtttactatcggctgggcatggtggctcatgcctgtaatcccagcactttgggaggccaaggtgggtggatcacctgaggtcaggagtttgagaccagcctgaccaacatggtgagcccctgtctctactaaatacaaaaaattagccaggcgtgatggtgcatgcctgtaatcccagctacttgggaggctgaggcaggagaatcacttgaacctaggagacagaggttgcagtaagccaagactgccattgcactccagcctgggcaacaagagcgaaactccatctcaaaaaaaaaaaaaaaaaaagtttactatcctggccaggcactgtagctcacacctcctgtaatcccagcattttgggaagccaaggcaggtggatcacctgaagtcgagttcaagaccagcctgattaacataatgaaaccctgtctctaataaaaatacaaaaaaactagccaggtgtggtggcacgcacctgtaatcctagctacttgggaagctgaggcaggagaatcacttgaacctgggaggtggaggttgcagcgagccaagatcacgccactgcactccagcctgggcaagaagagtgaaactccgtctcaaaaaaaaaaaaaagtttactatcttaatatccaagtggtgatatcaggaagaaagaagattttgaggatgatgccacgtagagatgaagccacacacatgctgcagatatccaattcaggttagccctgttgtatagagtaactctacattctaaaccataagacttaaggactatttcttagggattggattggacccacgtgcagaaccataaagacaaaaaacatctttaattctggaaacttttttcacagttacacaatggtttaatgacagaaaagtaaacagatccacctaaggtattccactacccctgtagagtgtctattacccagtctttaagtattttacagataaggtgtagaatgctagaatcaaaatgttatcttcctatatctatgtgttcttaaacctaaacaaattaccagatcatttatgtacattacaataaataaaggcttttcatgattccctcaatatgggtaagtaactaagttggcttatggcaaggctggccagcatgtaaccagaataattatctgttaataaatgattagtatcaagattagacagagactacagaatccccttaacgcgtgtcaaaacatctttcccaataactcgtgtttgtgattacataggataattctttatatccagaactaccgagtaaaaggcaaaacaaagcaacaaaaaaatgcacaacatattaaaaacttcatttttgtttaaaacatatattcatatgcatatcattcctgtgtatatgtgtatgtttttatgttaaacaatcacactatcatctctgggaaaagagattttgtaatacactgtcatgttttattttatttttttttgagacagtgtctcactctgttgcccagctggagtgcagtggtgtgatcatggctcactgcagactccatcctcctaggctcaagccatcctcctgccttagcctcccaagcagctgggactacaagtgtgcagcaccatgttcagtttttttgtttgtttgtttgtttgtttttttaagagacgggcatgtcactatatcgcccaggctagtttggaactcctgggctcaaggaatcctcccatctcatcctcccaaagtgctgggattacaggcaccagccaccatgcccagcctgaattaattaatttatttatttattgcgacagagtctcactctgttgcccaggctggagtgcagtggcatgatctcagctcactgtgacctccgcctcccaggttcaaggcattctcctgcctcagcctccctagtacgtgggacaacaggcatgtgccaccacgcccagccaatttttgtatttttagtagggagggggtttcaccatgttggccaggctggtctcaaactcctgacctcaagtgatccacccgcctcggctaccaaaagtgctggaattacaggagtgagctactgagcctggcctgaattttatttttaatttaaatattgcaccctgtgtcgctctctaccttcctccctccctcctttcttcatttctattcaagaaaaagcaagaaatgtcatacttttcaatcttagaactatttttgatcaagagctcctatttcaaatgtacatggcctctagcaggaataatatagcctgccaaagaatgcctctaaaactagttatctggccctggtgcagtgatgtgcgcctatagtcccagctgcccaggtggctgatgtgagaggatcgcttgagccaaggagttcgagtacagtctgtgcaacatactgacaccctgtctcttaaaaaaaaaaaaaaaaaattaactttttaaaaataactagatatctgaaactttttaactgtaacaattaagaaactggctggaggctgggcatggtagctcacgcctgtaatcccagcactttgggagaccgaggtgggtggatcacgaggtcgggagattgagaccatactggctaacacggtgaaaccccatctctactaaaaaatagaaaaaattagtcaggcgtggtggcgggtacctgtagtcccagctactcgggaggctgaggcaggagaacagcgtgaacccaggaggtggagcttgcagtgagctgagatcgcaccactgcactccagcctgggccacagagcgagactccatctcaaaaaaaataaaaaataaaaaccaaggatgtcttagaataagaatagctgcctaagaaagtatattattttaggaaggtagcacataaaaggtaattttcttctacttttaaactgccaaagataggttagtcaatattccacatcacctttccaacctcccccttctctataagggactgatctccgtatactcactagttcctcttattgctatccttctacccaattccttttacttcttgggctaataaccctcttcccatttgtcttcccttcgtttaccctatttctaagcaaaaacctctcctcagaccacaccacctctagccctaagactattactgctacctgccttttcaatgtggtctcctggctcttccaagccgtctgccacaaggaaacatcagtcctctgtcctcactctactgcccacataatagaagtactggtcactgaagccaaagagactaagctataaagagctaaaagaaattcaggagcttcaaagtcagcataggggagggacaggtggagaaaaaatgtagtgagaagagtggcactgttttacatgtccacatatctgttcgtatttggcttcagagaagacatctggatcttcagatctgcttctgcattcctttagatctgctgctattcttttagttcaagtatagaaagaaaactaaaatttactctcacgcagacacgcagttgtaaaagggagtagtgggctttttgttttaaaagatgggggtctcactatgttgcccaggctgaagggcagtggctattcacaggcacaatcccactactgatctgcacctgctccgtttcctcttccttaggtcatctggtgtcctccactgctggcaggtcaccatattgattccgaacttagtgcagacacccaatcagcatagggccctacagccaagaactcctggggctcaagccatactcccgcctcagcctccagagtagctgagactacatgtctgtgccaccatacccagcagggaggagtgttttaaagtcttagatgattgtggatattcctctttaacagtacaccaatacttaaccaatggtagtttcttagaggacagctgcaaagtggaatctgaaatcttatcaatgagtttttcatactgtttcattaaaacccactgtactatgtggtaggcagtgtctaagacagcccccaattttccctgtctcccagtattgataacctgtgggtgaataccttgagtacaggcaggattgaacagaatgtggcagacatgatgggatttcacttccagattacgttacaaaaagacagtggcttccgttttgggctgccctctctggctctctcatttgctctgtgttaagaatggatgcccccaggcaatagccacatgaatgagtttaggagatcctcctccattcaggctttgagatgaatggtagcctagctgacatgttgaccacacctttgtaggagaccctaaccaaaggccacacccagattgctgacccaaagaaactgagataacaaacgtttgtttttttcaggcagtttaattttggaacaatttttcactcagcaataaatatctaatacaattcatctcgcagtctgaatggatcttttacctatgcacaattttgtagtatcatgcattggttattcaaaaatacttgtttactgagtaatgcaaacatttcaaatattaatggtttcattacacagtattttaaaaatcatctgtttcatgtcaccactgatcttatcagaaagccttcaagtactgggaaagtatcaagctcacaaaggtgggtacaaaaaattttctaaaatcctgttttttgcctgaaagctcttttgtaatttatcattgtttttgagatgaggtctgtcatcagtaggctgaagtgcagtggtgcaatcatggctcatgccttgacctcccaggctcaatccatcttctcacccctcggcctcctgagtagctgggactacaggcatgtgccaccacacccagctcatttttttcttaattttttgtagagatgggggtctccctatgtagcccaggctggtgtggaactcccaggctcaaacaatcctcccgcctcagcctccgaaagtaatcccaaagtgttcggattacaggtgtgagtcaccacgtccggccaaacctcttttttaaaatcactgataacaaacactctcagttgtattgaagtaacaagctcacattttcaagaaaatgccaactgtcaaagtgtaaactgatagtctgtcagcgatttttcaagtaaaaagaatgttccatgaaaaaagctgcctacttcagctcgctactctaacaatcacacaagtgcttttccttaaggtaatcatagtacttcattatgccaaagtgctttgtgcatacatcctatttcaaacaatattttaaaactgtgtactcaaggatcaggatttaatgaaattaatcatttttattgcttcatcaagaacattattaaagaaaactgcttttaaattaatttattatttttttttgagttggggtctcaatacgttgcccaggctggtctcaaactcctgggctcaagcaatcctcccgcctcagcctcccaaagtgttgagattacaggtgtaagccactgcaactgtcctatttatgtttcttttatagacagggcctcactctgttatacaggctgcagtgcagtggcatgatcatagttcactgcagcctagaactcccaagctcaagcgatcctcccacctcagactcccaagtaactaggactacaggcacgtgccaccatgcctaacgaatttatttttattttttgtagagataagagtcttcctatgttgtctgggctactctccaactcctggttgcaagtgatctgttcaactgtggcctcccaaaggactgggattacaagcatgagccactgcacctggccctgccttttagattttttttgtaaacttcaaatatgcagcagtgaagaattcactatctagtgatacagcctgaagccaccacatgaattcaaccaagatgccagcagtctgactcatcattgtttctgaactatcagtctaaatgtcaccacaatgaaaataatttgatgtccagtataatggtgcatgcctataatcccagctacttaggaggctgagataagaagatcacctgagcctaagagttctggcctgtagtgtgctatgccagtcaggtgtctacactaagctcgacatcaatataattacctcccggaagtagggggaccaccaggttacctaaggaggggtgaactggcccaggttggaaacagaggtcaaaactcctgtgctgatcactagtgggatcacgcctgtgagcaaccactgcactccagcctggggcaacacagcaagaccccatcttgggaaaaaaaaaaaacccttagtattattacgtaagttgttttaactttacagacaacctgaaagggaatattagggacctgagcccacacctgaactgtgatttaaatcaatactgtcttaagaaaatagtttctaaagacccatttcaagttataacgtctaataatgaaaggtaagaatgacttcctaactgtaaaaagtcattctcagtgtcgtccttactgtacaccaattcagagataaaaaaaggaagaaagcggccaggtgtggtggctcacgcccgtaactccaatatgggccaaggccaaggccaaggcaggcaggaagcttgcttgagatcagttccatagcagccagggcaaacagcaatgccctgtctccacaaaacaaaacaattagccaggcgtggtggcatgcacctatagaaggctgaggtgggaggaatccttgagcccaggagtttgagactgcagtaagcaaggattgtatcactgcactccagcctgggcaacagactccatttctgcaaaacaaaagaaaaaaaaaagagtaaagtggggcttccaaatggaattcttctgcctctgttcaaaagcaatacagcacagaatttacttcctatagtcctacaaagacgctgtattattccttgcaataaagagaagataaagcttccaagggcattactcttttgctccaaatctattcctagcatttatatttttaaaattatgagcaatatggtatattaacagcataatgactatctgcagtgagcagtccagaaagcacttcattacactacagtattcagactttacagctttcctcttgccttttatttccaaatctagacagtatattcttttgtttcttgctataataaacaccaaagctgccaagttaaaaacatttatctcggccgggtatggtggctcatgcctgtaatcccagcactttgggaggccgaggcgggcggctcacctgagctcgggagttcaagatcagcctgactaacatggagaaaccccgtctctccaaaaaaaaaaaaaaaaaaaaaaaaaaatatatatatatatatatatatatacacacacacacacacacacacatatatatatatacacatatatacaaaaaataaaaattaaaaaaataaataaaaaggtttatctcataaaaactctcaactaaagtactttatcaaaagacatacatataattttattcatccttttgttacaacgtatatttcctcctcttagtttaccgatgaaggctatgtatgtattatcctaagtgaattaatgcaggaacagaaagccaaataccggacgttctcataagagagagctgagtacaaacagacacaaagaagggaacagacaccagggcctggttgagggtggagggcgaggattgaaaaaaatacctataagccaggcgtggtggctcgctcccgtaatcccagcactttgggaggttgaggccagaggatcgcttgagcccaggagtttgggaccagcctgggcaacatagcaagactccatctctattttaaaaaaaaaaaaaaaaaaaaagtaaagaaaggaaagaaagaaaagaaaagagaagagagaagagaagagaagagaagagaagagaagagaagaaaaactacctattgggtactacgctcattacctaggtgataatctgtacaccaaacccacgcaacatgcaatttacccatgtaacaaacctgcacatgtaccccaaacctaaaataaaagttggagggaaaaaaatttgtatgtctcttgtactcaattgtatttatttatttattttgagagagagtcttactctgctgcccagactggagtgcagtggcagtatctcggctcactgcaacctcagcctcccggtttaagcaattctcatgcctcagcctcctaagtagctgggattacaggcatgtgctgccatgcctagctaatttttgtacttttagtagagatgggattttgacatgttggctaggctggtcttgaactcccggcctcgagtgatctgcccacctcagcctcccaaagtgttgggattacaggtgtgagccacctcaacacaaagtatttctctgcattaactgttctcaatatatactatatacagttttctgtcttggtctgcccaagcagattgtaattccatcttgtatttttttctatataaactcatgattaacacaaactctttggcttacaaaagggaaataaatgcttaacgataaattaatctgattaaatgtcccattctctatcgccagtctctatccagattcatatcacaatttttcacatgaatgaggggttactgtgcccttcatccacatgaggaacagcacttctacaaactaagagagaaggtaaggcatatctagagagtaaggatatggcagtcaagtaggtatccagaaaataaaaataatcagaatcttttcattattcattcccattacaaggcagtaattctttttgctaacgtccctccttttggcattttccaacaaatatcaatttttaacatctgcttcactctttgtgagtcaactgtgcaactttcttgacaggactatagaaaaaataagaaatgacaccacacttctaacagtctcctagcaagccttcacatcttttgatggtttcattaaaatcctaaagaacaaaatcaaataaggctaagggaaaaaagtgaacttaccaccaaataatggttctggttccaccagtatttcctgcttttgaggaattggggcacgaacttcttctctattaaaaaaaaatgggaaaataaaaaatgaaaactgttttctgctacctgtttgctttctgtaaatactgtgaatatattcaaattaacgtagtgacttttagaagcacagtaataataagtttttgtgttgctatttttttgggggggcggtggagacagtgtctcactctgtcgtccaggctggagtggaccgacacgatcttggctcactgcaacctccacctcccgagttaaagcaaatctagtgcctcagcctccctagcagctgggactacaggcatacaccatcacacctggctaatttgttttcatatttttagtagtgacagggtcgcgccatgttggccaggctggtctcaaactcttgagctcaagcaatccacccacctcagccttccaaagtgctaggattacaggcatgagctactgcatccggctgataaatgagttttagatagtttccacataaagctcaagtggaaaagagtacctggcatatatagctcaaatggtttggaaataaaaacaatttccccttccctctcaagtttcctaccttaaattctgtcagaaaaaaagaaaaaaattttcccccaaaaaatcaggcagaaatgaacagaaaaatataggcttaatagaagcaatatcacattactactatatcaaagaataattaaatcacaaggacatattaaaataaactttaaaaggcagtgaatttcatgctaattatgaaagaggctaacaggtatgatcttggattatttactaaaaagatcctaatatacagaacaaaaaaagtaattactcatcttttaaaagcctattttcttcaaagtttacattcatagggtttactgataatccatctcttccaataagaaaaaactcatttagatatactgtaaaaatggtgtgtgcctttaaagattagtttattttaggttgggcatggtggctcatgcctgtaatcccagtactttgggagaggaggcaggaggctcacttgagcccaggagctggagaccaaccttggcaacatagtaagactccatctctaaaaaaaaaaagaaaaagaaaaaaaaaaattactttgttttacagttgtaactcaactattgaactttgctgattaatgttcacagcaaatagtaacttcctaattcattatcttcctgcttataagtattattatataagcatgcaaattccatataaatttatgttagccctaatggtttttttttttttttttttgagacggagtctcactctgtggcccaggctggagtgcagtggtatgatctcggctcactgcaagctccgcctcccaggttcacgccattctcctgactcagcctcccaaggagctgggactacaggcgcacgccaccacgcccggctaattttttgtatttttagtggagacggggtttcactgcgttagccaggatggtctcaatctcctgacctcgtgatccgcccacctcggcctcccaaagtgctgggattacaggcgtgagccaccgcgcccggccaatggttttcattcaggtgttctgaacagtattaactaaagatcttgtttttgacatttaagtgttggaactccaaaacatcctttatgaaatgaagtaggaatactcatttgtcaataattacatcctgtaatcaaagaacaaccagttaaagaaatttccaataaaccaagtgacaaaaggataattcaaaattatgttaagtaccctttcctactgctcacacacaaaatttcgataatctgaagaaacagacgacacatctataagagtaagctctgtcaatcctttcatcaaaaggaaataggccagccaggcatggtggctcacacctgcaatcctagcattttgagaggccaaggcaggtggatcgcttgagctcaggagttcaagaccagcctgggcaacaaggcaaaaccccatctttacaaaaaatacaaaaattagtcaagtgtggtggcatgcgcctatagtcccagctacttgaggcgccgaggttgcttgaacccgagaggaggaggttgcagtgagttgagagcagtaagcagagatcacacccctacattccagtctgagttacagagcaagactgtgtttttaaaaaaagagttaattatcttaagaaaactggtgcacacagtggctcacgcctgtaatcccagcactttgggaggccgaggtaggtggatcacgaggtcaggaaatcgggaccatcctggtcaacgtggtgcaaccccatgtctactaaaaataagaaaattagccgggcgtggtggagtgtaccagcagtcccagctacttaggaggctgaggcaggagaatccacttgaacccaggaggcagaggctgcagcaagccaagatcacacctctgcactccagcctggcgacacagagagactccgtctcaaaaaaaaaaaaagaaaagaaaaaaaaagaaagaaagaaagaaaacttttacctaaacaaaactttccattattgttatacctcgctttacagtgtgtgtgtgtgtgtgtatatatatataattgtctcaatctcagacaactcagttgttctataaacaaactttaatctgatgaaatgcatcaattagaggggtggattaagtagtacacttgtccttacacgaaaagacttgattactacattatctgagggtatctgtaccaagactgtcagctaccaagaatggaaggatggaacagaaaaaagtgaataaagaaaatcacactttaggaattaggagccattatcaaatgttaatcaattagcaatacaaactatctaagccaagttatatatagggcaattcattaggaaaagatattcatttatcaaaactatttttcaacacaattgagaaaacatgttttatacaatgaggataaatatgctctcccaaaacaactatgaatatttgctattcaagtttctgtattaggtggttttttgtgttttttttgttttttgttttttttttgagacaggaggcctcactctgtgtcatccaggttggagtgcagtggcacaatcatggctcactgcaacctcaacctcccaggctcatgtgatcctcccatctcagcctgccaagtagctgggactacagtcgcgtaccaccacacccggctaatttttgtattttttgtagagacagggttttgctatattgcccaagctggtctcaaactcttgggctcaagccatcctcctgccttggcctcccaaagtactagaattacaggcatgagccaccatgcctggactttttttttaaatattaaggttttcatactgatttctgttaagagtttgagctatattgggagcgaaatacatggccaacattaacagaaaaaactctacacaatattatttttattatttttttgagacagagtcttgctctgtcacccaggctggagtgtagtggcacgatctctggtcactgcaacctctgcctcctgggctcaagcaattcttgtgcctcagcctcccgagtagctgggattacaggcgcatgccaccacgcctggctaatttttgtatttttttttttagtagagacacggtttcaccatgttggtcaagctggtctcgacctcctgacctcgtgatcagcccacctcggcctcccaaagtgccgggattacaggcatgagccaccgcgcccagcctagcttcaagcatttttcatagcaactcaaaacatttctgtgacaatgtagaaaaacctaaaattgggaaatctgaactttactgggctctactgctacttaattgctgtgtagcttggggaaatggctatgcctctgcttccttattggtaaaatgttgataatgccatccaataaggtgtttgtttatttgctgctgccgtgaggcacacaggccctgctggccacgggccaatcctagcagagcaccaccacacactccaaccaaccccatctccccgacttcacagagcctacacggttcctttgaggattaaataagcaagacagtactctaaagaatttaaagtatgtaactacaaaaatttccacttcatactttttcagaggctttcagcctttcatttatttcaaaaccagagaatcgacctagctttgataaaaatgcaactacttaatttaggcaatggatagctcctgacaacacataataaattcatactctgtgtgtggtctgacagtagagacacttgctgaactggtactgggctcttcagcgattcctccaccatccaaaaacatagtgactgccatttccagattattgttgcacgcttcaagcatatgttttcctacactttcacttgcacctgaaacagtaaaaagacaggaaaaacgttaaaaaaaaaaaaaaaaaagacagcctctttcttcagctcatattagaattcccaagtaaattaatagtatttttcccttttagaatgaatgactttcttgtgaaatacacagagctagaaaaaaatgtagacattcttgaagtgaaatacagagctagaaaagaatttagcagcattaaagagtaatcatccttcataataaaacaaaaactaaataaagcattttttggccatttctttggccatttatttaaatggccaaagtatatatttgggaataagctgaaaaaagataaagaaaaatgaaagactacattctagaaagttagaaatgctttgttagaaagaatacatttcagttagcatttctgtttctgttaaaaagaaagcatcaggctgggcgcagtggctcacacctgtaatcccaacaccttgggaggctgaggcgggcagatcacgaggtcaggagttggagaccagcctaaccaacgtggtgaaatgccgtctctactaaaaacacaaaaatttgccaggcatggtggtacacacctgtaatcccagctacttgggaggctgaggtaggagaattgcttgaacccaggaggcagaggttgcaatgagccgaagtcacgccactgcactccagcctgggcaacagagcgagactctgtctcaaaaaaaaaaaaaaaaaaaaaaaagcatctttaataccaatggcaaagaagtgagatggaacattttttgtctaagacataactaagtcaaaatctggtaagaaatgtcaatcttcatcatttaaaaatgtccctattacaaatgtactcatttgtaaataaagtaaagctaacagagtctgctaaatgaaatgtaaattggtaaggtcctttaagacaacaattttacaacatgtattccagaaacaaaaatactcattccttttttgactcagtaatttgggcttctagtcaaaagaaaataaaatctacataaaatactatatgcataaacatgttcatacacatgtccagcatagcttcagtttatattgaaaagttggaaataacataaatgtctagtgatagaatgtaaattgaacattttctggccactaaaaagcacctcaagctttccatttgggatgatttttcttctatctgaattatgtcccttagaatctccttctcttggtggtaaatgctcttaagtttttgtctgcaaatgtctttatttcgctgtcattcctgacagttttactgggtattccatttcaaagctgacagctattttctctcagaatattgaagacagcattccaatgtcctctggcttctgttgttgctgctgggaaatcagttgccagactaaagaaaaatgtttttatagcaatctgttgtttctagttgcttttaagaccctctgtctttagccttctgcaatttcactctgatttgtcagggtgattttatttatcctctttggaattcaatggacttctaccacttgaagattatcttttatcaattctgaaaaattcccagtgatttatatttgatcgttgtctcgccccctccattcatacttatttcctctgtaactccaattagatgtatgttacaactcttcactctaacccttatgtctcaacctttctttcatatgcatattgtctctttgagctgtctatggtgcattgtgggtaatctcttcaatgctatcttccagttcacacattctccctttagctgtgccaatctgtttcttcacttgctcactgagcttttgatttcagctaattttttataactagaagttctgtttttgtttacgtcctcatctgcttgatcatgttttggagatccttaattcctactattccaatctttcatttcttcaaacatattaacccaacttattggaatcactaatcactaaggaaaaaaataaattttctacagtttctataggtcactgtttcttgtttctgctggatcttgctcactgtgtcacagtttttgtgtgatttgtgatttttttactgtgatgtcatgtgccttgaaattttaatctacagaattctgaagcctgggttgaaggtacatttcctcctaagaggatatgatttgacagactttgcaaggcacccacaggcactaccaaactgagaccactttaaatacacttctgacttggaggtttttcaagaccacatgagaaatgtgactgtaacaatctttgttataaattctctgtgaagatgttcatctccatacatcccctccccactgccaaggtagaagcgtcctactctctgctttatgaaggggaggagccttctttcaggcccctttccttgctaaggccccaagctttctttcctgtgacccatgagtctaccaaaagggaagttcaaagccatccagtgtggacagattccaccagacctgctttaaaggtagctaatttctgcattcttcatttttagcctggtgctaaccaataatgtattttaaaagaaactttttttttttttttttgagacggagtttcactctcatcacccaggctggagtgtaatggtgcgatcttggctcactacaacctccacttcagggttcaagcgattctcctgtctcagcctcccaagtggctgggattacaggcgcctgccaccacaccgggctaatttttctatttttagtaaagacagggtttcaccatgttggccaggctggtcctgacctcctgacctcaggtgatccacccgccttggcctcccaaagtgcagggattacaggagtgagccaccacacttggcctaaaaaatgttttttaaatacatacattcttcagcactttttttctcagcagcagggttactcatgttatcactctacattacccttactgcaagaaatggaagtgctaactctactcttaatgtctctcatttgttttctcttctgtactactgtctctaaggcaaatccttaatacttacctcaattacttcaataggctactaactgatcattattccattttctaccttgctgcagagggtatctcccaaaatacaagtctcattatatcatccctctgtttaaaatcacttcatggcagccaggcacggaggctcacgcctataatcccagcactttgggaggccaaggtgggcagatcacgaggttaggagttcaagaccagcctggccaagatggtgaaaccccatctctactaaaaatacaaaaattagccaagcatgtgagcacacacctgtaatcccagctactcaggaggctgaggcaggagaatctcttgaacctgggaggcggaggttgcagtgagctgagattacaccactgcactccagcctgggcaacggagcaagactccatctcaaaaaaaaaaaaaatcccttaatggctttcttctgctgcctgcagtataaattcaagtctttatgatctggaaagccctttgtgatcaggcctcagcttatttctctggctttgcctttcttcttcctcatcctacacagtttactatagtcaaactaaattacatgcttagaatgcccttatcctccccatcgtcccctcatctagttcatgcatgctgaaatcaaccgaaatgttactctgttgatctgtgcactagcctacctgcccgttcccatccctgtgataatgttctattatatccatggatatactactagtaaatgctggttccttttctggctcccccaaaagaatagaaggttcttgaacagaggaactggttttcttgccttggtatctcccagcacctggcatcacactttgcttgcatgtgatcaatgtctgataaacttagtgatatctcatagtactttaactcattagctacatactagagagagggagtaggccttagtcaaaaccactggcaacccttttataacaatttaattttgcactttgtgcatatacttatgttttaaaattaatttataaagcagtacagttatgctgtggaaataaatagcaaatggatacgctggattcatggatttaagataaatttaaagagaagtgaaaataacaggcttcaaaaaactagcagatggccgagcacagtggctcacatctgtaatcccagcactttgagagaccaaggcaggcagatcacctgaggtcaggagttcgagtccacctgaccaatatggtgaaaccccttctctattaaaaatatgaaaattagccggacgtggtggcaggcgcctgtaatcccagctactcgggaggctgagacaggagaatcgcttaacctgggaggcggaggttgcagtgagccaagatcgtgccattgcactccagcctggggcacaagagtgagacttcgtctcaaaaaacaaacaaactagcagatgacatggagtagctatagccttttctgatagctgataaagatatatatttaaggtgcaaatgaaaacaaccaaataaactcatttcataaaatatgactgaaaaaaggcggccggccaggtgcggtggctcatgcctgtaaacctggcactttgggaggctgaggtaggtggatcatttgagctcaggagttcgagaccagcctggccaacagggtgaaaccccgtcttctactaaaaatacaaaatcagccaggcgtggtggcaggtgcctaatagctcccagctattagggaggctgaggcaggaaaattgcttgaatccaggaggcggaggttacagtgagctgagatcacaccactgcactccagtttgggtgacagagcgagactttgtctcaaaaaaaaaaaaaaaaaaagaaaaaagaaaaaagcatgaatatacaacgtgtgtaataatgttaaatcaataaatattaccaaagaaagcacctgatcatttcacttaaatctctagaaacgcaaatagttgacggtcaactgttttttttagtaccagcttatacccattaaaaaggctactattaaaaaacaaaaaataacaagtgtgggtgagcatgtggagaaactggaaccaccatgcactcttgatgggaatataaaatggtacaacgagggtggaaaactatggagattcctcaaaaagctaacaacagaatatgatccagtaatttcacttctggagatatacccagagaactgaaagcagggtctcaaaaatatatttatatgcccactttcataatagcattattcacagtaggtaaaacatggaagccacccaagtatacatcaacacatgaatggataaacaaaagtagtatattcatacaatggaatctcatggagccttgaaaaagaaggaaattcggacatgaatgaaccttgaggacattatgctaagtgaaataagccagtcacaaaattacaaacgccatatgattctacttatgtgagacatttagagcactaaaaatcgagtcagaaagtagaatgatggttgccaggggctggaggaaggtagaatgaggaacagggagttcttgtttaatgggtatagagtttcagttttacaaaacaaagagttatagagagggacggtggtaatggttacacattattaatgtatttaataccactgaactgtaccctgaaaaatggttaaaatgggccaagcacggtggctcatggctgtaattcagcactttgggaggccgacgtgggcggatcacttgaggtcagttagagaccagcctggccaacatggtgaaaccccgtctccactaaaaatacaaaaattagccaggtgtggtggtgggcacccgtaatcccagctactgggcaggctgagggaggagaaccgcttgaacccaggaggcagaggttgcagtgagccgaggttgctccattgcacttcagcctgggcaacaagagcgaaactctgtctcaaaaaaaaggttaaaatgataaattttgttatatacgtgttaatacaatttaaaaaattgaaaaaacaaacaccctttttgggaaatttagagaaaatcgcctttcatttggggtctgccttttatctaggtatatatggtaatttaagttacacagaaccagggaggtttttcctttaaaagagcttcatacattactcaaatttgagaaacattcttagacccttctttctcccccgagtgaacatcccatcagttaaccaaagagagctatagttccttctagttaataccactcctaaccaaccttttctatgtccactgctacagtcttagttcaagccctcaacatctcttacatgaattactgtatctcacacctcatggccccctttgatatagtcatccctccagtatccatggggcactggttccatgactgtccaaggataccaaaatttgagaatgctcaagttcttcatataaaatggtacagtatttgcaaacaatctatactttaaatcatctctagattacttatagcacctaatacaatgtaaatgctattacattgtacctaatacaacgtaaacagttgttatactatagagaataatgacaaacagaaaagtctctacgtgttcagtagagatggaacaatgttttctttttccctgaatattttgtttcttttttgctggagtgcagtggtacgatctccgctcactgcaacctctgcctcccaggttcaagtgattctcctgcctcagcctcccaggtagctgttctgttgccaccaccatacctggctaatttttgtatgtttagtagagacagggtttcaccatgttggccaggctggtcttgaactcctgacctcaggtgatccgcctgccttggcctcccaaagtgctgagattatttacaggcatacgccactgcacccggccttttccctgaatattttcaatacgcaggctaaattcaccaatacggaacccatgaatatggagggccagatgtaccttcgacacagcaaaataatgtaagttcaattgtctgtcttcctatttcaacagttctgtattgctgattgaaaaagttttaatccatctcaagctgcatacaagatttgttccttacccctcccatgttatatccctctactctcatctcacctctgtaccattcccttcagccacatggacctaccggcatcatctaggcagttcccttggtaggactttataaaaccctatctttgcatgatttggatagtggttgggacaacaaaccaaacacccacctttctgttacgttctgaacatttcctctgcctcctcactctgaagcaggaacaaatatatacttttccattgagtcataatctttacccttgtctctgctagctgctctgtctctcagactttaaaagctcactcaactagcgcagatctcacttttctcatcccagttacattcttcctaagttctcagtggagctgaaccaaaagttaagttgtagtatatacaaatttaacattctaaccaacagaaaacactttaaaaaatgaaatatcaaaacaaaaacacaaatgcaactttttgaaggaaaggaaaagttctaatatccccacagccaaccttatgtaactaaatacaaattcttggggcaaaaacagcacaaatttgataaacaatttcaagacacatatgctaccatattcttactcataaaacctgaggctttgtttcagtgtttccctaatatttgtacattgcctccagttacattgtgttgtattatcatacttcttttttttttttttttttgagacagagtctcgttctgttgccaggctgaaaagcagtggtgcgaatcttggctccctgcaacctccacctcctgggttcaagtgattctcccgcctcagcctcccgaggagctgggacaataggcgcacgccaccactcccagctaatttttgtatttttagtagagacgggatttcaccatgttggctaggatggtctcgatctcctgaccttgtgatccgcctgcctcagcctcccaaagtgctgggattacaggcgtgagccaccgcacccagccatattatcatacttcttgaatgctggactatacaagttcagcaggctgggtgcggtggctcacacctgtaatcccagcactttcggaggccgagacaggtggtcacgaggtcaggagctcaagaccatcctggccaacatggtgaaatcccgtctctactaaaaaataaaaaataaaaaaattagctgggcatggtggcgcgtgcctgtaatcccaactactcgggaggctgaggtaggaaaatcgcttgaaccagggagtcaaaggttgcagtgagccaagattgtgccactgcactccagcctggtgacagagcgagacttcatctcaaaaaaaaaaaaagttcagtgactactgtgctctaccattttaatttagacagcagctaaaaattaaaggtttcttacaggaagactactttcggctgcttgttctagcagagatgcacaatctgttaacatctgcgtcccaatgaaccctaaaactagcttctcaatgtatggaccaaactttcttttcagagaattaagtggccaagttcacactattttggctcttgtctaagtgctcacaccgcattacagcaccacaaaaaagcagaaagaacatgttgatggtgaagtgaaactcacttctgccataacagcaaccaatgctggctactttcattcacaaacttatctggtcataggaaattcaacttacaccgggtgcggtggctcacgcctgtaatcccagcactgtgggaggctgagcggggggcggatcacctgaggccaggagttcaagaccagcctggccaacatggtggaactccatctctacaaaaattacccgggcacgatggtgggtgcgtgtaatcccagctactcgggaggctgaggcgggagaattacttgaacccaggaggcagaggttgcagtgagctgaaattgcgccactgcactcctgcctgggcgattgagcaagactctgtctcaaaaataaaaaaaaaaggaaaaaggaaattcaacttaaaaatgccactgcatacaaatattgttgccaccctttctaccacccttcatctaccagaactccaatgccactgccaggggaaccatttagagaatttgtgggttctgatgagaatcagaacttgtgaagtcaatcctcaagcaagcaggcctgtcaacattttagtctgcctagcccaagtcttttcctaagtgcagtttttttccacgttattatgctacctaaaatacttccaattcagagattaatttgggtaaacaaacattctatttaaaaatatgaagacttactagagttaaggatgtatcaatcatttcataacataaattaattcaatcatattgccttctcttaaaagctagtaacaatacatttagagtcgatatacagaggaaaagggtgttgatttagaagaagagggatgtaagtagctttagtgtcacaagtgcctttttggggagaggtaagaaaggcctgcagtaccacgtgagggcaacttagggcaggaaaagacactgaacacctggagccacagacacagcaagaagttaaaataaatgtacacacaggcgcggcggctcacgcctgtaatcccagaactttggggggccgaggcgggcggatcacaaggtcaggagatcgagaccatcctggctaacacggtgaaaccccgtctctactaaaaatacaaaaaattagccgggcgtggtggcgggcgcttgtagtcccagctgctggggaggctgaggcaggagaatggcgtgaacccggcagcggagcttgcagtgagccgagatcgcgcgactgcactccagcctgggagacagagcgagactccatctcgaaaactaaataaataaatcaaataaataaataaatgtataaaaacctttgcctccgccctgtcttatgcccagtaacaaagagaaaatattcttcaaattcccttctgtactcatgctaaggagcacagaagatatgatttaataagagcctgggaactactcagctaaacctgggttcgaccttctacttctgtcattcactagtgtgactctgagtaagatactaatttctctaggcatcagtttcctcagttataaaatggggatttatcaacttcatgaagtgctaccatgaattaaaagaattcagctgggcgtggtggctcacactgtaatcccaacactttggaaggccgaggcagacggactgcttgagctcacaagtttgagaccagtctgggcaaaatggttaaaaaaaaaaaaaaaaaaaaaaaaaaaaaaaaaccatctctacaaaaaagattagccaggcgtggtggcacatgcctgtagtcccagctactcaggaggctgaggtggaaggattgcttaagtccaggagttttgaggctgctgtgagctatgatcataccactccaacctgggtgacagagcaaaatcctgtctctaaaaaaaaaaaagaaaagaaaattcacattaaagaacttgggatacctcttaattagcagttagctattaataaagactggccaggcacagtggttcacttgaagtcaggaattcaagaccagcctgaccaacatgtgaaaccctgtctctactaaaaatacaaaattagctgggcgtgatggtgggagcctgtaatcccagctactcgggaggctggggtgggagaatcgctggaacccaggaggcagaggttgctgtgggccgagatcacgccactgcactccagcctgggcgacagcaagactccattgaaagaaagaaaggaagaaaagaaggaaggagggagggagggaaggagggaaagagagaaggaaggaatgacggaatgacggacagatagtcccaagtttacagtactctatacgtaaatgacatggaagtataaagtgtgaatatatatagcttatggagaaatacatttttgacagtaaacaggcagagaaagacatctcagttttctttttctcactcatctgatgctatgaacatgtgtctcattcaagttgaacactcatttttttaaaagcagtacaatgaagacagcaaaaacctattacactagaaaaaagtgaatggtatgcatagagaacaacatgatacacgaaagggatctgcttcaaagacatctataacagcactccagtgtgactgagaagcactgagaggtgatagggaggcagtagaaaactaaatacaagtacagtatgtatgtattctagaatttctaaagattcacaggtctatagagctaaacattaaaacagaaaggattctacagagaatgacattacgacacaacaaataaaaccatagtaacggaagtaacaactgtaatattttggggcacatgatgtcaacactcagggtccagagttagaggatagggaaagactactttgccatcctatctacaatcttcacacaatcatttaatgcgagaacctaacctttagggagcatattcctgagatggtgctaccataccactggtaacaatctgaggtcgagcgcggtggctcacgcctgtaatcccagcactttgggaggccgatgtgggtggatcacttgaggccaggagttggagaccagcctggcccacatggtgaaaccccatctctactaaaaataaccaaaattagctgggcctggtggcgggcgtccacctactagggacgtcccagctactagggaggccgaggtggaagaatcacttgaacccagaaggcgtaggttgcagtgagccaagatcacgccactgcactgcactctgttgcctgggcaacagagcaagaccctgtctctaaataaattaaataaataaataaataaataaataaataaacaatgtgacaggatgacttccatctttggagtctgtcaggatagtgaactgcaagagcgttccaaagaaagtaccactacacatgcagattttttaaaaggaagcacatgctaaatcttggttaagtctgaacaaagccagtgctagaaagaagcccatgaagcaaagtataccatccactttcttaaacaaagccaagctaagccatctgttcccgtatcatcagttgttcttagcgtatcacttagtgaatcatttcagaaacaggagctaactgaaagataattaaaggttccagtggttcttagtgtcgaagcactagaggcattcagtaacatgagagaccatttttggtgtttcatgcctggggagtcggggatactactggcatttcatggagagaggccaggggtgatgtggtggactgaaaaacgtcctccaaaagactactcgaaccttcatttcagacttccggcctccagaaccatcacagaataaatctgtgttaaaccactcaatttgcggtaatttgtcagcagtcaaaggcaactaaaagtattaaacttctggaatggatagaacagtcctactgtaattgccaataacactaccactgagctacacagaggaatatgaagaagtgaaggttaactgaaagggaagaggaaaagtaaggagggctaaatgatgtaagtgagggaacagtgataaacaagtttagtgaagttacacattttacccacattttacctatgcacccaagagggacttaacaatttctgatggatcagctgtaaagaatttggacttctatcttactacagttagaagaacatacctttttttttaagggggggctaataaaacaagtttgacaagtttacgatttaaactatttgcaaacttgttaaaaatgggctttttgggactgggtgcagtgtctcatatctgtaatcccagcactttgggaggccaaggtgggtggatcacctgaagtcagaagtttgagaccagctaacaccgcgaaaccccgtctctactgtaagtacaaacaaaattagccaggcatggtgatgcgtgcctgtaaccccagctactgaggagtctgaggcagaagaatcgtttgaccccgggaggtggaggttgcagtgagccaagattgcgccattgcactccagcctgggtgacagagcgagactccatctcaaaaaaaaaaaaaaattaaattaaattaaaaaacggacttattttgaggctccgatattgtaggcagcagcagggtggcttaatctaatccagtcatctatactccatgacaggagtcctactttgtttctcaccacatgaacccccttctaaaacatcctttatctgtccttctctccatctgttttacacttgctactgaatggcaccaaacggccttccttaacccagctgtggcacacaacttatgatggccattttcatgctgctatctcctagtttatactctaatgcacattgtctacactactctcagtgccaaaagacggacagtgatcatctcttcactaccatccagaaaccaaagtatagcagtcacagagacttttaaaaacaatcatcatcatccctctatagaaatgatagggacaagaggttacttttcggttccacattttccccagcaatgataccaaagtaagctaaactatttgccaaggatatgggagtggatgacagttgtgagaaataagctgaaattttaacctcagtctctaatcctggagtttttaagctttcaaatatcgaaaacatttttaaatgcataccagaaaaaactgagtacagagaaatcgaattactaagttaggggacagataaggcaaacattcattagttcacaaaaggaaccaatggtgcaggaagtagtgctaatggtgggaaatgcatgcgcccaggagccaagatgccagagttccaggccctgttctgccatcacctaggccagtactacccaaatggtagtccttagaccagctatctcttactagtctgtgacaagataaaaatacaaattccagtggaagcattcagaaacgtttacagcaatttgagagagtaattttatgtctgttgaatctcataattaaaagttggggcttgaaagatttatggatagtggccgggtgtggtggctcatgcccataatcccagcactttgggaggctgaggcaggtggattacaaggtcaggagattgagaccatcctggccaacatggtgaaacccccccccagtctctagtaaaaatacaaaaaattagctgggtgtggtggcaggcgcctgtagtcccagctacttgggaggctgaggcaggagaacagcttgaaactgggaggtggaggttgcagtgagccaagatcgcaccactgcactccaccctggcaacaaagcgagactccatctcaaaccaaaaaaaaaaaagatttatagatggtaagttattacatgaaaaatgccccaaatcattagtcacctgagaaatgcaaattaagaccacaatgacataccattacacacttattgaaatggctttaaaaaaaacaatggccaggcacggtagctcacgcctgtaatcccaacactttgggaggttgaggcgggcagatcacttgaggccaggagttcaagaccagactggccaatgtggtgaaaccctagtctctagtaaaaatacaaaaattatccaggcaaggtggtgcacgcctgtagtcccagctacttgggagggtgaggcaggagaatcgcttgaacccaggagacagaggctgcaataaatcaagatcacaccactgcactccagcctgggtgacagggtgagactccatctcaaaaacaaaaaacaaaaaagcccaggcgtggaggctcacacctgtaaccccagcactgtgggagaccaaggcaggagtttgagaccaacctaggcagcacagggagacctcatctatacagaaaattaaaaattagctgggcatggtggtgtgtgcctgtagtcccagctactcaggaggctgaggcaggaggattattgaccccaggagcttgaggctgcagtgagctatgataacacggctgcactccaccaggggcaagagaatgagatcttgtctcaaaagaaaaaaaaaaaagacaattaaaaataccaaatgatggaaagaatgcagaacaactggaactctcttttattactattttttaatacagatgtgggggtctctctttgttgtccaggttggcgtcaaattcctggcctagagcaatcctcccgcatcagcctctcaaagccactatactttccaaagtgactttggaaagtcactataccagaaagtcacaaattatttgtcagcttcttagaaagttaatataactattattatatgatccaataaacacactcctaggtatttatcaaaagatattcacacacttgtacacgactgtttttggcagctttatttataatgtccccaaactggaaagtgtccttcatttgataaatgcataaacaaaccacagtacaaccatacaatggtatactattccccaataaataggaaggaactactaaccatgacaacatgaatgaatctcaaacacaatagtttaagagcaagaagccagactcaaaaggttacatattgtgattacacttacatgacattctggaaaacaggagactaaaaacagactaggctatgggcagcccagcccgccaagtcctcgcctggctgcatgccagcctgatcaagccataaccagaggacacaacagcccaacctagcggggccagtcaccacctggtctggggatcatctctaccacaagcggctgaggcacagctgccctggggagggcggaaggccaggcatgtgggctaaactggcaggtcaccgcaacatgtaagtgtttccacgccagcaaacatttactgagtatctaccacgtataagaacattggcaacaagccctccaacaagccggtccctgagaggagcatgtggacagtgcctgtgtgggccaatggaccctctgtggagctggccccctcatccgctccagattgtggcctggccactgtgcctcttttcttggctgtgatggggcttggggtacttgttcccctcctgcctgaccattaggtgccagctggcttcactgtatccttgggaaactgtggagctgggtcatggaagagtggggacatggcagaggcctgaaactcagctcagagcctcagggagcataaggtggggcatagcaggacaatcccagtcttggagacaagttgcttatctgcctggcctccaacccccatctgacttatccacttgacaaggtgagtggataaacccaaagtaccttggggcacttaaagtcctgcatggatgtgaattttatcaactctaagattctgaagcaccacagggacagaagagagccatcttgaagctaattgtgttagctaaacaaaggactaattagagactaattattccatttacaaaataatttttcactttttttttttttttttttgagacagagtcacactctcttgcccaggctggagtgcagtggcaagatcttggctctctgcaacctctgactcccgggttccagcgattcacctgcctcagcctcccgagtagctgggattacaggtgcccaccaccatgcccggctcattttttgtatttttagtggagacagggtttcaccatattggccaggctggtctcaaactcctgatctcatgtgatccacctgcctcaacctcccaaagtgctgggattacaggcatgagccaccacacgtggccactcctgatgctttaagtgccatgatactctcctggttttcctcctacatctttggtttttcctgagtcttctctgcactttcttctttgcagtcccccggatgttggtgttccttcagcattgtgtcctggagtctactatttcccacactacactccctcctgcaagatgccatcctttctcttttcctaatttttttttttttttttttttttttttaagagacaaggtctctctctgtcacccaggctggagtatagcagcaggagcatagttcactgcagcctcaaagttctgggttcaagcaatcttcccaagtcaaccaggattacaggtgcacaccaccaggcccagttaatttttttttactttttgtagaaacaggctctttgctatgttgcccaagctggtcttgaatttctggcctcaagcaatccttccaccttggcattccaaagtgctgggattaccggtgtgagccactaggcctcgcctcatccatttttataacctttttttttttttttttttgagacagagtctcgctgtcgcccaggctggagtgcaatggcgtgatctcagctcactgcaacctccgccttccaggttcaagcaattctcctgcctcagcctcctgagtagctgggattacaggcacacaccaccatgcccggctagttttgtatttttagtagagacggggtttcaccatgttggtcaggctggtctcaaactcctgacctcaggtgatccactcgcctcggcctcccaaagtgctgggattccaggtgtgaaccaccgcacctagccccatttttataactttaactgccatgaatatgacagatttctcactcttctttctagacccaaatattcatctgcttcaacagctccatctggaagtcctattagcagcaccttaacttatccaaaactgagctaaccatcttctccccacacctttctgctattccataccttcataaatagcactgttacatacctaggtgtccaaaacagaatcctaaacttcattttgactctgatttcttcccataccttttggagtccacttctccgccactaacttttttcaggacaccactatctttcttgggttaatataacagccttctactgatctctgtgcctatctcttctccattatagccaagtaactctttctttaaaaaaaaaaaaaaggtcaaatcagatgtaactccttttttaataaataaaattttaatacattttgtagagatggggtctcactatgttgcctaggctgatctcaagctccaggcctcccacctcagcctcccaaagtgcgggaattataggtgtgagccacagtgcccagtctcactcctctaattaaaacccttgactccccactattctcagaataaagacaagattttttttaacatggcttataaggcccaacccaatctcccatttatctcttgaggtccatttattgcactagctgtgctttactcatttggaattatcaattccctaaaccgattgtctcccctctctcatctctgtctgtatacatgtctgcccaattcccctccaagtctctgcatgtttctcctgcaagaaacatcttccagattttagataaaaaagtatttattctgggaaggttttcttgacctccctcttttgtgctccagtattagctccttaccattctctcactgtattctaatacctattcgtgtgtctctattcctgttaacctttaagctttctgaggacagacaccacgccttgctcacagttgtatccttaagatgtgaaccatgcctggcacgtagcagtctaccaataaatgaatctactagtaagattccattcgcaactcaaaattacctcccttaaatttctgaaacttcagccaggcatggtggctcaagcctgtaatcccagcgctttgggaggctgaggtgggtggatcacctgaggtcaagagtttgagaccagcctcgccaacaagatgaaaccccatctccattaaaaatacaaaaaatttagctgggtgtcgtgacgcgcatctgtggtcccagctgctcaggaggctgaggcaggagaatcacttgaaccggggaggcggaggttgcaatgagccaagatcacagcactgcactccagcctgggtgacaggataagacttcgtctcaaaaaaaaaaaaaaaaagaaattctgaaatgtattccctattgaaactattcttaaaattcctgaagttttctcttaacatctataatactgtgaccacctttccagacacagagaacttaatcatagtttaatattaacccaagagaaaggaaatgttctgtacaaaagcatatgaatgaggccaggcgcggtggttcacaccggtaatcccagcactttgggaggtcgaagcaggaggatcacctgaggtcgggagttcgagaccagcctgaccaaaatggagaaaccccgtctctactaaaaatacaaaatgagccgggcgtggtggcgcatgcctgtaatcccagctactcaggaggctgagacaggagaatcgcttgaacccgggaggtggaggctgcagtgagccaagatcgtacctttgcactccagcctgggccacagagtgagactctgtctcaaaaaaaaaaaaaagaacatgaatggaaattggccataaagttaaataccacaaacatgacagcccctaatttttataataaatatgcactcatcaaccatctgaaagattaaggtctcttctacaactgaggttctataattttctcaagtatgttattgccgctatgcacaaagctctatgaatttccgtaccagtaacctcttgtactcttcttagcctccactttctatgccctcacatttgtccttagactgctagcttatttttcacctgttctatagtgtctatgtatccctcaccttcactccatgaattattctgattacacatgtgcaccagtgtatatgtgtagtggatgtcagcccaaagttggtgctaatggaatactgccatggctcaaaacatttttacttttatttactttttctttttttgagacagggtctcgctctgtgctcgcttcagcagcacatatactaaaattggagacagagtctcgctctgtcgcccaggctggagtgcagtggctggatctcggctcactgcaacctccgtctcctgggttcacgagattctcctgcctcagcctcctgggtagctgggactacaggcgtgcaccaccatgctcagctaatttttgtatttttcggagagacagggtttcaccaggttggccagactggtctgaagctcctgacctccggtgatccacccgccttggcctcccaaagtgcctgggattacaggcgtgagccaccgcacctggcttcaaaacatttttaaaaattgctctttcagaatagatccagctgcatatttttccttcatgttttgagaattgatatgacttctgagttttcaacagtaattcaaagccatgtatgataaatatcagaggagatcaaacagtagtattgtaaaatgtggaatgactataaaagtaacaagactggttttcttatgtagctttaaatgacacagaaagcatcagtggggccggttgcagtggctcacgcccataataccagcactttgggaggctgaggagggcagatcacttgaggtcagtttgagaccagcttgcccaacatggtgaaactccatctctactaaaaatacaaaaatcagacgggcatggtggcttgagcctgtaatcccagctactgcggaggctgaagcaggagaactgcttgaacccaggaggcggagacagcagtgagccgaaatcatgccactgcactccagcctgggtgacggagtgaaattctgtcgaaaacaaaaacaaaaacaaaaacaaacaaaaagcaagcatcaatggtaaaccatactgtatacagcttctcagtgtggttacttcaaaggtcatcacttctcttggctacctgcttatcagtctgaccatgcaaaaaaggtttgtagcataatgttaagtgaaaatttcagaaccgtgtattttagctgggcatggtggcacatgcctgtagtcttaactgctctggaggctgaggcaggagaatcacttgagcccaggcggtaaggatgcagcaagctataattgtgccactgtactccagcctgggtgacagaacaagaccgtctttaaaaaaaaaaaaagaaaaagaaatctcagaaattgtatatactatgatccacaatgtaaaaataagcatataaacaagaagtggaagataatatgtaaaataaatattgctgttgtgagaaggagaattagttcttttcccttttatcaaaattatttcggccaggtgcagtgtcccacgcctgtaatcccagcactttgggaggccaaggtgggtggattgcttgagcccaggagttcaagaccagcctgcacaacaaagtgagaccccatctccacaaaaaataaagaaagttaccctagaggctgcagtgagccgtgatcacaccactgcactctagtctgggtggcagtgtgagacccagtccgtctcaaaaaaaaaaaaaaaagtttttatgatattgtctttttaataatcttttttaatcagccattactgaaccaggcacagtgatgtgcacctgtagccccagttactgggagggctgaggcaagaggatggctgagcccagaaactggagaacagcttgggcaacaaagagaggagacctccatctcttaaaaaaaaaaaaaaaaaatcaaaaatccgtcattaggccaggcgcggtggctcacacgtgtaatcccagcactttgggaggccgaggcaggcggatcacgaggtcaggagatcgagaccatcccagataacacggtgaaaccccgtctctactaaaaatacaaaaaattagccaggcgtggtggcaggcgcctgtggtcccagctacttgggaggctgaggcacgagaatggtgtgaacctgggaggcagagcttgcagtgagccaacatcacgccactgcactccagcctgggtgacagagcgagactccgtctcaaaaaaaaaaaaaacatcagtcattatttcatactcactgaatcagagagagatctgttctattcagtaagaaataagacttttctaaaatctttcaattttccgttctatttctaaatgccaaaaaaagataagactcacatttatttttattttttctttttcttttttttgctcctgcctaaaaagtaaggactcacatttttgatgatgcatttgtttttacaagaatattgagcttccaagtaaaacctttgtgaaatcagagcataagctattaaggtcactaaaataaatataaaataccttttaattataaacactacgattaaaacgtatgtggagagaaccccaaaaaaattttaagacatgtaaaaaaggcaaaaagaaatcaatcatgtgtttctaacggttaatcactatcttgtaaaaagaatcccaaaaattatcaatagaaattcacaatatttgaagaacactcaaaggtattttcgctctgtagatctccagataccactgtctactgattgagggactccaacttgatccagcaatcaagctacgtagacgaacagaaacagaattaaagcaattaagtgagtcaattcaactcaccacacttcggtttttgtgtgtacctaataaaaatgttgcaacagaagaagtaatgtggcgttaaaccaatcagagtttgggaagagtagtaattagcataagaaactgaaaattaattaagtggcttttagggccaggcgcggtggctcacgcctgtaatcctagcactttgggaggctgaggtgagtggatcatttgaggacaggagttcaagaccagccaggccaacatgatgaaaccccgcctctactaaaaatacaaaaattagccgggcctggtgacaggcgcttgtagtcccagctactcgggaggctgagacaggagaatcgcttgaacccgggaggtggaggttgcagtgagccaagatcgtgcctgggagatctgcactccaacctgggcaacacagcgagactgtctcaaaataataataataataataataataagtggctttttttttctttttgagaaatgatcttgctctgttgccagggatggagcgcagtggtatgatctactcaccgcagccttgaactcctaggctcaagcaatcctcccacctcagcctccccagtagctgggactacatgtcggtgccactacatccagctcattttcttatttctgtagagatggggcctcactatgttttgcccaggctggtctgcaactcctcgccccatgtgaatctccagcctccgtctcccaaactgctaggattacaggcgtgagacaccgcgccaggcccaagtggcatcataaaccatctctaggaaatctaaaggattaataatgatattcacttctctatcagattcactgcaaagatttttctatataagcataatgcagcaacactaacttatatacacaataatcttctccatagcaatgatttgtcagacattaggaaatcctttacatatttaatataataatccaatcctttatatcttcaataatccaatcacaaagttcaaaaatattaagagaagttatcatgcaactcctcaccccaattttattgcaaattttactttactttgacctgatgttccatgcccacaagctagataacaatgcgtcaaatatctcgttatcattgcaaagcaaaaaaataaaacttgctttaatataaaacggtaactagtatacaacctgtagtagttaaaacaatataaaattttacttaaccagatattgcacgttaaactctaggaacattaacagtggaaacattctccgcatctaacaaattacgagataaagtatagatccgttgagagggaactaacattctgacctccttccaaaacgacaaactagaacggcaaaattacactcaggcacattggagtactcttctctcaaatcactccacagagaacttcatcatttgctccgccctctaataactcatgcaagaaaagttcagcaccatcagagagaaacaagacagagagaattcatagaatggctttagggcctttcctccaggcggtaagaggatctgcgtgtgtccttcgcaggggtccaaagggagagaacctaggcctagggtttcggggataccgacacccagaaacagattttctctcaaagaagtttctgccgccatccctatcttatcagcaggaggccccggcgccatcgtctccgtctttatgattttattatggggaggtgggaaacgccaccctggattcttccaggcctcccctattcagcttgggggttccccctcattcttccctcaaagcctcagtccctgaggtcctcctcagcaccccccgcttctggcggcctgtcccccgtgaagtgtaaaggcacggccgaacccaccggccttgccgtgaaggcgggagggcccgaacccgccagggccacggcgatggctccgaggggcccagaaaggggaagggcaggccggggaccggggcagaatgacctggccggggaagaaaggaaaaaaggaggtgaggagatgcaccgcaccgcagggctgcacagagaagggaagatgatgaaggaggaggaggagggcggtggcccgggtgcggccccctactcctcccgcccccgggtccccgggccggcgggggcggacggactcggcccattcccaggtctgggctggcggggggttgggggatctccctccacgctactaggagacagagaacgagggtatcgggagcgggggggggctgtctcccgcctgaacccggagaccccgacgccgtcgtcgcctcttcctcaggagggaggacggcagctgtgggtaaagcccgaaggaggaatgcctgaaggtaaggggaagcccggggcagacccgctgcccgctccggaccccactctccaccttccggtaaccgcgtctcttaccggtaatggtggtgaactgttgaattaaccccttcagcgccgaggacgccgcggagcccccgtgggcagccatcttaccgccgccgccgccgccgaacaacaacacagacacacacggactgccctcccccacttcgccgtgcggtgtgcgcaggcgcattgaccgcccctcgagccccgcccctcccgtccccagcggtctgcgcaggcgcattttccgaccgggcccgcgcgctcccagctctcgggttggctgctcggttgctgcctgctcagtgcatcctttttgccattgctggtgccttcctctccgggctccaaggctagcctcgcaggcgcggtgtcgattcctagattccgaaggaagcttcggtctcggcagatagttcttcgcatttcagcttcgcaagctttattgacagagccaactgccgatgacagcatttttctgttttgcggttgtaccgcactctattaggtttcctgcaggtcccatcaaaatgcaaaccctacctcctcgctttgaagcgactctccccgtactcgccccccagcctctaaactaatggcttagctaaccgattgcgacgagtgaaataccagaacccttcatgccaaagaaagcacttagcgcggggttgccacccagtaggttttcataaacgattgtttagtctgctttccttaaataaattggccatcacgtctcccgttagggtcttaatgagaccccaagaggcgtcatttgtataaaaagaaactctgtatatgcagtagaggaaagaaaacatatagaaaggagactggaaaagtgtgctcaaaacgctggtaacggttacctccagagaagagaacgatcgggacgatggtcaaagcggaccttacttcgagtttcttatttatctttttatttttaaacaaacattattggccgggcgcggtggctcatgactgtaatcccagcactttggaaggccgaggtgggagaatcgcttgaggcaaggagttcgagaccagactgggaaatatatcaagaatccatctcaaaaaaaaaaaaaaaaaaaagatattcgtgtgttccttgaataattttaagtattttgcaaaacagttacatgagtggggtgcgctcaaatccaataatcccccaccttgcccataaagttaaaagagattccaagtgattccgtttgttttagcctcccaccttccaacctccacccacatattttgcatcttcataggaaaatggcccaataaaagatgggatgagctgtctgaagaattgacacatcctaagagtaaacatgctattggggagaattaagaaagagccatgtcaaatcaaggggtatagttttttgttttgttttgtttgacagggagtctcgctctgtcgcccaggctggagtgcagtggtgcaatctcagtttactgaaagctccgcctcccgggttcaagcgattctcctgcctcagcctcccaagtagctgggattacaggcacacgccaccacgcctggctaatttttgtatttttaatagagacgaggtttcaccatgttgagcaggctagtctcaaactactgacctcaagtgatccacccgcctcggcctcccaaagtgttgggattacaggcgtgagccaccacacccagtcgggctgtagtttcaagaagatatgattgatgtaaaagaaagcagactccagtaatcccagcactttgggaggccgaggcgggcggatcgcccgaggtcaggagttccagaccagcctggtcaacatggcgaaaccccatctctactaaaaatacaaaaattagctgctgtggtggcgcgggcacctgtaatcccagctacttgggaggctgaggcaggagaatcacttgaacccgggaggcagaggttgcagtgagccgagatcatgccactgtgctccagcctgggtgacagagcaagactccgtctcaaaaaaaaaaatgtattttaagttaaatgacagattggtcctggcactgccttccaggttgctgcagttctctagatgggctgaggaagggcagggatcagtcataaatttcggcagctgattccttcacatttgatgcagaggtgcaaaaacaggcaagggaagaaagccaaatcaagaaagtgttacctctgtctcccttcatcctaaaggctgagtcactagccagccatgcaaaatcaagctccacgtaaaatggtataacaccattaactacaaaaactaaacacagtgattactgtacctccatcagatggagaggccagtaatgagctctgcaggtttatcaggtttatttccaaaatcttataattcagatttaatgatatgattttgattaacagtgcaggaaaaggtgataaagtctgtggcatccacaactccagaaggcatttttttagaaattaaaaaataagataaaagaaaattagacaggtggccaaaaagattccatggtcggggggagggggggaaagaagggaagaaaatgagacagtttccatggataaccagggaactgggaaaaataaataaagaagtaatgaataatacaaccttgaaaagcttttttggattattaaagaatatgaaggactgaccagttgcggtggctcacacctgtaatcccagcactttgggaggccgaggctggggatcacctgaggtcaggagctccaaacccgcctgaccaacatggtgaaacaccatctttactaaaaatacaaaattagctgggcgtgatggtgcgtgcctgtaatcccagctactcgtgtggctgaagcaggagaatcgcttgagcccgggaggtgaagtttgcagtgagccaagaatgagctactgcactccagcctgggcaacagagtgagactccgtctcaaaaaaaaaaaaaaaaaaaaaaaaaaagaatatgaatatgaaggatgggtgtcgtggctcatgcctgtaatcccagcactttgggaggccaagacaggaggatcacttgagcccaggagcttgagaccagcctaggcaacatagggagaccctatctctgaaaaaagaaaaaaaaagtttaattagccaggtgcggtggtgcaagcttgtagtcccacctactctggaggctgaggcgggaggatcacttgggcccaggtggtcgaggctgcagtgagccatgatgacaccactgcactccagcctgggtaagatatgtggaaatcacaaggaacagtggaggatctcatactagtaacagtagaactgtcacaacccatacgtccaaagagatgagaacagagagaagttagagaaatcccaagtgagatttttttgcagagcaaaccaccatgcaagaagcaatgaccttctgtcaagggacataaataagcagcttgaggcaatctcagagaggagctcagggacatagataccctgacctcgatctcctcttctgtctcctgccaggaatccccaatggctgaacccaaatggaagacagagggcacagcaagaagccccttgtagttcccacaggcagccccggggcagagagcaggatggaaaagaggaaattgatggacacaaatgtaaaatggaatggtcatggaaatacattccaaaacttgaggagctttttggtttgtttgggtcttttttgtttcatcttgttttgttttttgagacagggtctctctctgtcgcccaggctggagtgcagtggcaggatcttggctcactgcagcctctgcctcctgggttcaagcgattctcctgcctcagcctcccaagtagctgggattacaggagcaggccaccatgcccagctaatttttgtatttttagtagagacaaggtttcaccatgttggtcaggctggtcttgaactcctgacatcaagtgatccacctgtctcagcctcccaaagtgctgggattacagggtgagccacagagcctggcccgaaactgatggagttttaacagaagctaaaggagaatatataagcttaactggttatattagagaagaagactggaaaataagtagctcagcatttcatcaagaagttaataaaggaacaacaactcagcagacaaggaaaaatgtgaagaaaaaatgctaaagagcagaaattgacaaaatagaatacaaaatacagaagagaggattcataaaaccaaaagctggttctctgaaataacaatatgtaaaacctttgacaggccaggtgtggtggctcacacctgtaggcccagcactttgggaggccgaggtgggtggatcacctgaggtcaggagttccagaccagcctggccaacatggtgaaaccccgtctctactaaaaatacaaaaattagctggacgtggtggcgggcgcctgtaatcccagctacttgggaggctgagacagtagaatcacttgaacccaggagacagaggttgcagtgagccgagattgtgccattgcactcccgcctgggtgacagagtgagactccatctcaaaaaataaaaaaataaataataataaaacctttgacagattaagaacaaagagaaagacacaaacaatattatgaaaaaaagacatagcagacatagccgtggcttgaaaaataagagaatattatgaataattttatgctgatgaattaggaaatagataaatgacagtttcctagaagaaataattaacaaaatggaactcaactatgcatagacttatgaccattaacaaaatgaaatctgccacacaaatgaccacaccccagtgattttacaggagattgctaccaaaaaagttaagaaacagattatcccaaacttatacaaatgcttccagataaagaacaatgggaacaaacagctcattctataagggtagcataaccttgaaatcaaatcaaacaaaataataaatgagaattcatcctcactcatggctactgaaacagatatcttaaattaaatcagaatttagaaatccacatattcacacatacatgtacatattttttttattgggtttacttcaggaatgcaagcataattttacagtaaaaagctcttacaaatggcacagttgctcgcccctgtaatcccagctacctaggaggctgaggtaggaggaccactggagcccaattgtctaggagtttgaagctgaatgagctataattgcaccctgcacactccagcctggacaccagaaactccagaaaaaaaaaaaaaaaacacctctgtcaatgtaattcaccatagtaaaacaaattaaataagagaaattatttgattcatttgatcagacacaggaaaaccattgatataaatgcacatccattcacaaaatgttttaaaaaccttaacaaactacataaagaaacttccttaatctaataaaatgtatctaccaaaaatgcagagtaaacagcatcctagttaataattagacatttaaagtcagtaacaataatgcgttctattattacgtctactcaatattattctagaggttctaaccatggcagtgagacaagaataggcagtaaattaaaaacctatattcaggggccaggcgccttggttcacgcctataatcccaacactttgggaggcctaagtggaagcatcgcctggagccaggtgtttgagagcagcccagacaacatagtgagacctcattgctacaaaaaagaaattgttttttaattattcaggcatggtggcacatgcctgtggtcccagctacctgggaggctaagatgggaggatcacttgagtccaggaggttgagccatgactgcaccactgcactccagcctgggagatggagtgggaccctatctcaaaaaaaaaaaaaaaaaaaaaaaaatctatattcatgtatggaaagactcaatattataaagatgccagttttccatatattagtcagcaaattcaatgtaatttcttttttttttccttgagatggaatctcgctctgtcgcccaggctggagtgcagtggtgtgatctcggctcactgcaagctccgcctcccgagttcaggccattctcctgcctcagcctcccgagtagctgggactacaggcgcccctcacaatgcccggctaattttttgtatttttagtagagacggggtttcaccgtgttggccaggatggtctcgatctcctgacctggtgatccgcccgcctcggcctcccaaagtgctgggatcacaggcgtgacccactgcacccggccaattcaatgtaatttcaatcaaaatctcacagagtttctaagcatttgtgtaaggttatttttaaattcacgagtaaagagtcaacaataatcaaaacacttttgaagtaaaaggacttgtggaagtcttgccctaccttgtattaagaatttttaggccgggcgcggtggctcacgcctgtgatcccagcactttgggaggccgaggcgggtggatcacgaggtcaggagatcgagaccatcctggctaacacggtgaaaccccgtctctactaaaaacacaaaaaattagccgggcgcgttggcggccgcctgtagtcccagctactcgggaggctgaggcaggagaatcacttgaacccaggaggcggagcttgcaatgagccgagatcgcgccagtgtactccagcctgggcgacagcgcaagacaaggaaaaaaaaaaaagaatttttataggccgggcacagtggctcacacctgtaatcccagcactttgggaggccaaggcaggcggacttcttgaggtcaggaactcaagaccagcctagccaacatggtgaaaccctgtctctactaaaaatacaaaaattagcttgggtgggggggggcgggcggttggcacgtgcctgtaatgccagctccttgggaggctgaggcaggagaatcgcttgagcccgggggacagaagttgtaatgagccgagactgagccactgtactctagcctgggtgacaggaacaagactctgtctcaaaaaaaaaattattataaaggtgtagtaactaagactactcacactgtgtggtattgatagggagtgaacaaatccagtacagaatagagagtccacaaacagacacgaatatatacagacagtgcggcagaagtggcatgactaaccaatggaggaagggatgcactgtgacccagggttccaatcccaaatcggatacaaaaatacattatatatttctgaaagatttaaatgagaataacaaaacttgacaactttcttttttttggtgggggggttgaggggacggaatttggctctcgtcgcccaggctggagtgcagcggcgcagtctcagctcaccacaacctccgcctcctgggttcaagtgattctcccgcctcagcttcctgagtagctgggattacagacacgcgccactatgcctggctaattttgtatttttagcagagacaggtttctccatgttggccagactggtcttgaactcccaacctcaggtgatccccgcccacctcggcctcccaaagtgccgggattacaggcatgagccactgcacctggctgaaacttgacaactttcacaagaaaatataggggcttattctagtgatttctaatagaactgctttgcacaacttaaaggggatgccgtccactctgcatcccaggaaatgccatccacacaacacaacataactggacagccttgaagttgtggatcatgaaagtccagcttgaggaaggggaagattttataaagaagacacgaaatcagaaaccataagggcaatgactaataaagttgacttcattaaaattagaaacatctgttggccaggcacagtggttcactcctgttatcacagcactttggaaggctgaggcaggcgggtcccttgaggcctagagtttgagagcagcctggccaacatggtgaaaccccgtctctaccaaaaatgcaaaaactagctgggcatggtagcacatacctgtagtcccagctactcaggaggctgaggcatgagaatcactagaacctgggaggcagaggttgcagtgaactgagatctcgccgctgcactccagcctgggcaacggagtgagactgtctcaaaaaaaaattaaaaaaagaaacatctgtaatgtaagaagtgaaactgggatttgaacccagacaaaatgaattgacagaaagtttggggaggtgatgtgcatagcaattagtattttaaaaaaaagttcaaagaataaaaatatttcagttatttttcagcacttctcaggtgggccaatatcgctaccaccaaaaagacatattatattgtgggacaggcattaagttgtttagggtattggatgttatgtcgggaaaacgaaatttagctagcttaaatagcaaggtgagctagggtagggcctgtgttgggtaccacagggctccagctctgcctctgattctcttgactttcccaggactgtctgagctttgttctaggctggtagcaagacagctgcagtagtctgaagcatcacattcaggtacagtgacatgcaaaggaagaagcatcagctcatctcttctgtgagaaaggacacatttcctagaagtctcctgggagagacattccttcaaaattcgtctgaattgagtctgaattgagtcacaattctgttcctaaaccagtctctgccaagggatgtgagataaacataactggtgtagtaaagcatatggctttgtggaggaaggtggatacctccccaaagtttggtgcttttaaggagaaagaaggaggggaatgaatgttaattaggcaattaacaaaatctgctccattcatgaagcttcactatgagcaccgtgaaacattcccacacttcccttcgttctgattccacctttacctagaatctttctgattgacacttaacttttccagatttcttgatactaggaaagtactgaatgagtctgtcagtcactgaaaacatctatctctcactattaaatttaaaaattgatattttggtttagggttagggttttctgttcctacgatttttgctatttctagaatgttatgtaaatggagtcaaacagaatgcagtagcctttcgagtctggcttcttacacttagcataatgcatttaaagttcctcatggcggtgtctgcgtctgtatctttttccttttcattgctgagtatcagtccatcataaggatgcatcccagtctgtctatccattccccagttgaagggcatttgggttatctcgttaggggcaattatgaataaagctactataaactcatgtacaagtttctgtatgaacataagttttcatttctcttctaaaaacacctacacgaggaattgctggctcatatagtgagtgtatttttttttttttttttttttttgagatggagtctcactctgtcgcccaggctggagtgctgtggtgcaatttcgactcacacaacctccgcttcccgggttcaagcgattctcctgcctcagcctcccgagtagctgggattggagtcacccaccaccatgcctggctaatttttgtatttttagtagagatggggtttcaccatgttggccaggctggtcttgaagtcctaacctcaggtgatctgcccgcttcagcctcccaaagtgctgggattacaggcgtgaaccatcctatcaggctgtgagtgtatgtttgacattataagaagctgaaaaactgtcctgtgattccttattttttatttaatttttatttttttttagacggagtctcgctgtgtcgcccaggcttgagtgcaatggcacaatctcggctcactgcaacctccgtctcccgggttcaagcatgttctcctgcctcagcctcccaagtagctgagattacaggcatgcgccaccactcccggctaatttttgtatttttagtacagatggggtttctccatgttaatcaggctggtcttgaactcctgagctcaggtgatccacccacctcggcctcccaaagtgctgggattacaggcgtgagccaccatgcctggcctggcctgtgattcttaaatgtcaatttggggaagatatctggcaaccatcactttaaccaagtgatccaacttaacattaatgagtgggacaacctgataattttgatgtgatgcgttaggaaatgttcagtatcacctatgacatattcttggcaaaactgtaccaatcaagcctctaggcctaatttccagactacaaaaagtataggaagatcaagatacaagttaaaggaggccatgaggaagcactcaggcaaatctagactatgggcattcataagataactgtcctggtctcttcaaaaagtgaacgtcagccgggctcggtggcttacgcctgtccatccagcactttgggaggccgaggcaagcggatcacctgaggtcaggagttcgagaccagcctgaccaacacggcgaaacaccatcactaccaaaaatacaaaaattagcctggcatggagggaggcgcctgtaatcccagccactggggaggctgaggcaggagaatcacctgaacccaggaggcagaggctgcagtgagccaagatcgtgccactgcactccagcctgggccacagaccaagactcagtctcaaaaaaaaaaaaaattaatttaatttaatttaaaaggccaggcacggtggctcacacctgtaatcccagcaccttgggaggccaaggtgggaggatcactggaggtcaggagttggagaccagcctggccaagagagggaaacaggggaactgttatgaatgaaaagagagtaaagacattacaggaagatgcaaagctttgattgaatcctggtcattaaaagcaatcttcctgcctcggcctcccaaagtgctggaattatgggcatgagccacagctcaactgaatttctcccaagggccaggtgccgtggctcatacttgtaatagcgctttgggaggctgaggtggaaggatcacttaaacccaggagtttgagagcagcaacataacaagactctatctctacaaaattaattaattaattaattaaaaattagctgggcatggtggcacaggcagcttgctcggagggcttagatgggaggactctaaccacccagcaggttcaccttgcccactgcctagatagagctgatttaccaagacaggaaaatttaaacaaagaaacagcgattcacagccggctgcatgggagaccagagtgttgtgttttattgtgttttgttttgttttgtttgagacggagtctcactctgttgcccaggctggagtgcagggacacaatctcggctcactgcaacctctgcctccagagttcaagcgattatcctgcctcggctgccctcgtaactgggataacagtcgagcgccaccacgcccagctaattttttatatttttggtagagacggggtttcaccatattagccaggatggtctcgatctcctgacctcaagatccgcccacctcggcctcccaaagtgctgggattacaggcgtgagccaccacgcccggcctgggacgggagatttattactactcaaatcagtttcccctagcacttagagatttttaggataatttggttgggggttgggggttggggggcagtgagtcaggagtgctgattgattggttcggagatgaagatgtaagaagtgggagctgtcttcttgtgctgagtcagttcctgggtcggggccagaagatcagatgagccagtttatccatctgggtggtgccagctgatccatcaagtgcagagtctgcaaagtatcccaagcgctgatcttaggttttacaatagtgatgttatctccaggagaaattcagagagggtcagaatcttacagcctcctcggaggttgcagtgaaccaagatcaaactactgcactccagcctgggtgacacagcaagactccgtctcaggaaacaaaagaaaaagaaaatgaaaaaaaacccacaatcttacagcttccagcttcatggctcgtaaactgtaatttctatcttttggctaatttgttagtcctacagaagcagtctactccccatgcaagaagagggtttgttttgggaaagggctgctattgttttggtttcaaactataaactaagtttctcccaaagttagtttggcccaggaatgaacaaggacagcttggaaaagttttgacaaaggaaggaaggaaaaaagggagggagagagggagggagggaaggaggaaggaaggaaagaagggagcgagggaaggaaggaaggaaggaaggaaggaaggaaggaaggaaggaaggaaggaagatggagtcggttaggtcagatctcttttactgtctcagttatagtcttgcaatggtagtttcatgatcacttgagcccagaaggtccagcctgcagtgagctgtgattgagccactacactcagcctgggctatacagagtgagaccctgtgtcactagcaatgataatgataataataacttttaaaagtttaaaaagaaataaatttaatttacccttaaacttgaaagcaaggatgataacagtccctccctaaaactaatcccctccttgctcaaggaccaaaaactgcctttgtggaaccaataaaaggccacaagattaggattgtgggaggggcctgaactctgctaaaatgtaagcgtagtttatttttcttttctttcttcttttttgagactgagttttgctcttgttgcccaggctggaatgcagtggtgcaatctcaacttaccgcaacctccgcctcccgggttcaagcaattctcctgcctcggcctccgaagcagatgggattacagacgcctgccaccatgcccagctaatttttgtatttttagtagagacagagtttcaccgtattggccaggctggtctcaaactcctgaactcaggtaatctacctgcctccacctcccaaagtgctaggattacaggcgtgagccaccacgcccagcctgtaagtgtagtttctataatccctttctactcaggaatcatgtggccagaagccacaaaacaggtgtagtttctccatccccagttgcttctatagatattgtcactattgcagaacctacgattacttttttgagatttttctttggactgaccacctgggcttgggactcatgactgtggccccacctagaggtgaactcagcacacatggactgttttccacacccctctctctttttttttttttttttttgagatggagtttcgttcttgtcacccaggctggagtgcaatggcatgatctcggcttattgcaacctccgcctcccgggttcaagcgattctcctgcctcagcctcccaagcagctgggattacaggcatgtgccaccacgctcggctaattttgtatttttagtagcgacgggtttcaccatgttggccaggctggtctcgaactcctgacctcaggtgatccgcccgccttggcctcccgaagtgctgggattacaggcgtgagccaccatgccctgccacacccctataattttatatccaaccaatcagcagcactcattttctagccccttgcccaccaaattgtccgcaaaaaccctaaccttcaagccttgggagagactaatttgagtagtaactccgtctcaaatgtggttggcgtcacattaattaaactctttttttatggcaataccatggtctcagtgaactggttttgtctgtgcagtgggcaggaagaatccatcaggcaatcaaaatttctactttttttttttttttttttttttgagacagagtctcgctccgtcacccagactggagtgcaatggtgagatctcggctcactgcaacctccgcctcccggggtcaagcaagtctcttgcctcagcctcctgagtagctgagattacaggcatgcaccaccacgcctggctaatttttgtatttttagtagagatgggcttcaccatgttggtcaggctggtctcaaactcctgacctcaggtgatctgccctcctcggcctcccaaagtgctgggattacaggctgagccaccgcacccagcccacataattttgtaaaaaaaaataataataataagcagctcagagtaaaaaagaaaatgcctaagtacacacacaaaatccaagtaccatgtattagaagcagtatgaacaacagatagagtgaacagacttgcaaatagttcaatactggaatttcagacattgatttatataataagtatgtggccaggtgaggtggctcatgcctgtaatcccagcactttgggaggctgaggcgggaaaatcacctgacgtcagaaaattgagaccagcctggccaacatggtgaaaccctcgctctactaaaaacacaaaaattagccaggtgtggtggtgcatacctgtaattccagctacttgggaggctgaggcaggagaattgcttgaacccaggaggcagaggttgcagtgagccgagatcatgccactgcactccagcctgggcgacagagtgagactccatttcaaaaaaaataaaataaaataaaataataaaataaaatatgtttatcatgggtgaagaaattgtaatcccagcctgaacaatatagcaaaaccctgtctgtacaaacaaataaaataaaatcagctgggtgtggtagcatacgtctgtagtcccatctacttgacgggcagctgggtgtggtagtgtatgtctgtagtcccaactacttgacaggctgagatgggaggattgcttgaggccaagaacttgaggctgcagtgaactatgaccgcatcaccgcactccagcctgggtggcagtgagaccctaggaaaagaaaaaaaaaaagcaccactgcgttccagtctgggtgacagagcgagatgcgagactcaaaaaaaaaagtgtaagaatttgttgaggtctaagatgggacatttctccagagggaatttacatttgctcctgcctggcattgatgggcactaccacaccagtagcaactaactcaactcatcatttgaagctttctgaaccacacacgcaatatgaatttgggctgcaaatcaacatgtaagaactgcccaggggctacagcttctcaggacagccccctctcctcaccccccatcaccaaggtaaccttgcttgcagcctcacaatgcaaggagtagaagggctgtttacttctggttctcgttaccagagaggtcctagtgttttgtggagcatttcctattagatctcttttggcagataaactgtgtgcccccttcctcccaacagattcctgtgttgaagctctcactccccagtacctcagaatggtactgtatccctttaaggaggggattaagttaaaatgaagccttagggtgggccatgatccaatctgactgtgtccttatatgaagggaaatgggccgggcacggtggttcacgcctgtaatcccagcaccttggaaggccaaggtgggcagatcacctgaggtcaggagattaagaccatcctgaccaacatggtgaaaacctgtctctactaaaaatacaaaaattagctgggcgtggtagtgggtgcctggtaatcccagctacttgggagcctgaggcaggagaatcgcttgaacccaggaggcggaggttgcagtgagctgagatcacaccattgcactccagcctggtcaacaagagggaaactccatctcaaaaaaaaaaaaaaagaagaggaaattaggacacacagagagacaccaggggcaagggagcacgcacagaggagagaccacaggaacatacagcaagaaggcatctctctgcaagccaagcacggggtccttcggatgaagccagacctgccagtcttgatcttggacttccagcctctaggactgtgggaaaatacatttctgttatttgagcccccagtctatggtattttattatggcagccctagcaaactaatgcaattccccacctttggtggccttggcctttgacttttttatttcacagccccttggggtttcactcttgtcgcccaggctggagtgcaatgctgtgcattcttggctcactgcaacctccgcctgtcaagttcaagcaattctcctgcctcagcctccagagtagctgggattacaggcacccaccaccacgcccggctaaattttttgtatttttagtagagacggggtttcaccatgttggccaggttgatctcgaactcctgacctcaggtgatccgcccgcctcggcctcccaaagtgctgggattacaggcatgagccactgtgcccagccaccacttccttttcttttctttctttctttcttttttttttttttttttttgagatggagtcttgctcagttgcccaggctggagtgcaatggcatgatctcagcttactgcaacctccacctcccgagttcaagcaattcttccacctcagcctccctagtagctgggattacagacgtgagccaccatgcccggctaatttttgtagagacagggtttcaccatgttggccaggctggtctcaaactcctgacctcaggtgatccgcccgccttggcctcccaaagtgctgggattccaggtgtgagccaccgcgcccggacttccttttcttttctgagatttgatttgtcccactcattccttactatcttgccacctctgtgatgacgttaagaggtatatttgtttgttttaaaacaatatccagcttttcagttattctcattgtctatccaaataccttcccccacagatcagctaaaaggtagagaagtcaagaaatgacagcagagggaccgaggagctgatgaggaaaaagtgaagggcaacttcaaggttttcagcctgggaggaggtttaaaaaatggtttcaaaaaaataaaaataaaaataaataaaagaaacaaaacaaaacaaaaaaatgaaaaaaagttggtttctagcaagaaaagaaagaaaagcaaaggtcagaaagaaaagcaaattttcagagaacaaccgactttggtttgtatctgtactggacacgtataagtttttgttttgttttgtttttggtcattgttcactaaacaatacaatataacaactattgcatagcatttatgtgttttttgttttgttttgttttgtttttttgagacggagtctcattctgtcgcccaggctgaagtgcagtggtgtgatcatggctccctgcaacctccacctgggttcaagcaactctcctgcctcagcctcctgagtagctgggactaaaggcatgcgccaccacactcagttaatttttgtatttttagtagagatggggtttcaccatgttggccaggctggtctcgaactcctgacctcagatgatctgcccatctcggcctcccaaagtgctgggattacaggcgtgagccactgcgcctggtctaatttttgtattttttgtagagacaaagttttgccaggttgcccaggctggtcttgaatttctaacctcaagtgatccacctatctcagcctccgaaagtgctgggattatgggtgtgagccaccacacctggccatttatgttgttattaggtatcctaagtaacctagacatgatttaaagtatacaggaagatgtatgtaggttatatgcaaatactacacattttatatcaggagtttgagcatcctcagattttggtgtgtgtgtgtgtgtgtgtcttgtaagatggattctcactgtctcccaggattgaatatcctcagattttgtgtgtgtgtgtgtgtgtgtgtgtgtgtgtgtgtgtgtgtgtgtgtgtgtgttttgtaagacagtctcactctgtctcccaggctggaatgccgtggcgcaatctctgctcactgcaacctctgcctcccgggttcaagcgattctcttgcctcagcctcctaagtagctgggatcataggtgactgccaccaagcctggctactttttttttttttcagatggagtcttgccctgtttcccaggctggagtgcggtgccacgatctcagctcactgcgacctccacctcccaggttcaagcgattcttctgcctcagcctcccgagtagctgggattataggcacgtgccaccacgcccagctaatttttgtatttttagtagagatggagtttcaccatgttggccaggctggtctcaaactcctgaccttaggtaatctgcctacctcggcctcccaaagtgctgggattacagacgtgagccaccgcatccagccccagctaattttttttttggatttttagtagagatgggttttcaccatgttggtcaggctggtctcgaactcctgacgtcaagtgatccgctcacctcagtttcccaaagtgctgggattacaagcgtgagccaccatgcctggctaatcctcaaattttgatatccaagggacttcctggaaccaattccccatggacacgcagggaaaattgtaatagtaagacatcaaaaggtaagaaaggaataacattttcagtcaaatgagaattgctatattgtaagtgtgtatcttcatacacaaactcatgtaacaggaaatataattttatttttctataactcagtttaacaatttaacaatttaacttttattattcccatcagcaccataggaaaagtaacaatgaaaaaaaactgttactattcccagaccagggaatccttatgtagtctaaggatgtggtagcctgtttacttgtcatcaattctaccaaatctatcggccatagcctttttttttttttttttgagacaagggtctctgtcacctggactggagtgcggtagcatgatcatagctcactgcagcctcaagctcctggcctcaagagattctcccacctcagcctcccaaagcaccgggatacacatgagacatgacacctggctatagtcaagttttgtttgacccatctgcaggttttaaaattcaaaagctggccaggcatggtggctcaaaccagtaatccctgcacctgggaggctgaggtgagtggattacctgaactcaggagtctgagaccagcctggccaacatggcaaaaccccgtttctactaaaaacacaaaaattagcccagtatggtggtgtgcacctgttgtcccagctactccgggggctgaggcaggaggatcacttgagccttgggaggctgaggttgcagtgagccatgatctccagcctcagtaacagagggagaccctgtctccaaaaaaaaaaaaaaaaaaaaaaaaaaaaaaaaaaagcaaaggctgtggctgcaggtcacacctctaatctcatcactccgggaggccaaggcaggaggatgccttgaggccaagagttcaagactagcctggacaacataagagaccttctctctccaaaaagtttaaaaaatgaccaggtggggtggtacactcacgtagtcctagctactcaggaggctgaggtggaaggatcacttgagcccaggagttggaggttacagcaaactatgatcacgccaccatactccagcctagacaagagagcaagactttgtctctctttttttaataaaaaacattttcatttatttatttcagaagagaactagagtgaagaccttgtctcttaaaaaaaaatcaaaagctgacaattgattcctttcttcctccttcccctaacctgctaccatgtcaatggcattagttaggagtggttttggctgcaaataacagaacatttgaataccagaggctttagtgattgaagattgtttctctgtttttgttttgttttgttttgttttttgtttttgagatggagcctcactctgtcgccaggctggagtgcagtggcgcagtcttggctcactgtaacctctgcctcctcccaggttcaagcgattctcctgtctcagcctcccaagtagctgggactacaggcgcccgccaccacaccccgctaatttttttgtatttttagtagagatggggtttcaccgtgttagccaggatggtctcgatctcctgacctcgtgatctgcctgccttggcctctcaaagtgctgggattacaggcgtgagccaccacgcccggtcccaggaactccctcttacaaagcagttcagggctatggtggtttaaaaatactatcgaccaggcacggtggctcacgcctgggaggctgaggtgagaggattacttggggccaagagttcaagaccagcctgggcacatatagtgagacctcatctctactgaaaaaaaaacagctgggcatggtggcaagccctgtagtcccagctcctggggaggcggaggagggagtgttgcagggtccctgcagtgttggttttctggccagaaaactctgtggctggtggcacctttgcccgagttttactcaggccctctggggtcattttgcccactcagcctggcaggctgtgctcagctcatgctaccagcctggatctcatgcttgccaagggcgaggcaggtgtggagcagcgaggggtgtgtaagcaagagaactggggtctggcatatcttctatttctgtgtcttgccctgtcgggcttttcctatcactactgtcaacgtcctgtagaaaacagaaaaagactgagtgaaccaggggaaaatatcaaatcgtaagatgtaagtctaattacactgatactacagccgaactgtcactatacattattattactaataaggtatatttctttctttcttttctttttttttccagagtcttgctctgtcgcccaggctggagtgcagtggcgcggtctcagctcactgcaaccttcacctcccaggttcaagtgattctcctgcctcagcctcccaagtagatgtatatttattcttaacagtatttttatttcatgggcaaatttagattaagctattacttcattttcattcccttttaatgattgtgttacaatataaattgttccttttgtaaagctactatatatcttaattttttagttaaaaacattatcctcaggaaatgttggggcgaggagaactcggagtttgtctaaggctgtcaccttgctatgttgttttggagcttgcaggggtctggggctcaaggtctcattctctaggagctcacactgcagctgaacttgtaatgctgcttttttttttttttttttttttgagacagagtcttgttctgtcgcctaggctggactgcagtggtgcgatctcggctcactgcaacctccacctcccggattcaagagattctcttgcctcagcctcccaagtagctgggattacagccgcgcaccaccatgcccagctaatttttgtattttttagtagagatggggtttcaccatgttggccaggctggtcttgacctcctgacctggtgatccgcctgcttcggcctcccagagtgctgggattacaggcgtgagccactgcgcctggccaatgcttcttttttttgagatggagtctcactctgtcacccaggctggagtgcagtggtgcaatcttggctcactgcaacctctgcctcccgggtttcagtgatccttttgcctcagcttgctgagtagctgggattacaggtgcctgctaccacgcccggctagtttttgtatttttagtcgagacagagtttcaccatattggtcagactggtcttgaactcctgaccttagctgatccacccaccttggcctcccacagtgctgggattacaggtgtgagccaccgcgcccagccaacatcaggtatacttacaaatctattttcttgtgttgagttcgttctgtttctctctgaaaggtagatttttgaaatgcaaaagcatgaaactaacttctttttctcccaggtgaaccctttcctgaaggaagaaatggagaacggcccagatgactaaatcagagaaggaccacataatccaaggatagggtaaaatattggttaatattttaaaaacttatcctatcacatatatgcgatgtcactgaatcttttcaacaattttatgagaaataaattctattttacaatttaggagagaggttagggctacacagctagaagcagaatttggccaggcacagtggctcacgcctgtaatcccagatactcgggaggctgaggcaggagaattgctcgaacctgggaggtggaggttgcagtgagctgagattgtgccattgcactccagcctgggtgacacagcgagactgcatctcaaaaaacaaagaaaacaaaacaaaaaatagaagcagaatttgaatccatgtctatctgattctaggatcctgtccttgccatctcattgtacaatacctacaggcattttaaaagtgtaacttgaatgttccagttcttatcagcctaggggtgcaaataaggtcacatcagcacttacccacaattttgctggcaggtcacccctcatttgctcacacagaacctcagcttccttcaaaatgcctccccaaaagattcttgtagctatccaagaacgagtttcctttattaagtactgccgcgctctcatctccttggcaaggagaactgacacgaacatgatattcttgctgcttgctgtgccatgagtaataaagtcctttttctcataccaggaatttgatgtcttctgccaacactcatgaagcagtaataggctaacttattagcttgtgagtagggtaaaatcatcccagccctgacacatggcacaggcttgaggtcaggtgctatgtggtggcaaccacaagaagctgttgagagtccagtgacaactgggtactataggccgggcccagtggctcccgcctgtaatcccagcactttgggaggctgaggcaggaggactgcttgagcccaggagtttgagatcaccctgagcaatatagggagatttttttttttttttttgagacagagtctcactctgttgcccaggctggagtgcagtagcgtgatctcggctcactacaacctctgcctcccaggcttaagtgattctcccacttccacctcctgagtagctgggattacaggctcttgctgccacacccggctaatttttttgtattttagtaaagatggggtttcatcatgttgcccagggtggttttgaactgagctcagccaatccacctgccttggcctcccaaagtgctgggattacaggcaagagccaccgcgcccgaccaatatagggagatcttgtctctaccattttttttttttttaattagctgggcatggtagtgcatggctgtggtctcagccacttaggaggctgaggtgggaggatcatttgacccaggagtttgaggttgcagtcagacgagatcacgtcacggcactccagcctgggcaacagagggataccttttctctaaaaaaactagaagaaagaactggttgctgtagcagtggctgccataagaaaaaggtaaaccagaggaatcgaaagaagtgtctctactgtctctctctgcaaatctcattagccactgtcctgcttactctcaatgaagactaggaaagctagtgctgtcaagcaagaactcctttgacggctgggcgcggtggctcacgcctgtaatcccagcactttgggaggccgaggcaggcagatcacctgaggtcaggagttttgagaccagactggccaacatggagaaaccccatctctactaaaaatacaaaaattagctgggcatggtggcacatacctgtagtcccagctacttgggaggctgaggcaggagaatcacttgaacccgggaggaagaggttgcagtgagccgagatcgtgccgctgcactccagcttgggtgacagagtgagactccatctcaaaaaaaaaaaaaaaaaaaaaaaaaaagaactgcattttctggtatgaaatcactgatatgagctgacttactttctttttttttttttttttgagacagagtttcactcttgttgcccaggctggggtggagtgcaatggtgtgatcttggctcactgcaacctccacctcccgggttcaagtgattctcctgcctcagcctcccaagtagctgggatcacaggcaggtgcctccacacttggctaattttgtatttttagtagagatggggtttctccctgttggtcaggctggtcttgaactcccaacctcaggtgatccgcccacctgggcctcccaaagtgctgggattacaggcgagagccactgcacccggccatgagctgactttcaaaatatgaggctgtcaatgactgttggttttcaggggtgtattcaatgaaccaagttgtccctgactgatgtgatagatttataaactgttctagtggttacttgttggcacagctatagaacaatctatcttttcctaggagtgtgggaactctgatttgcatttggaaatgtttctgtaactcattatatagaaagggtcaatcttcctaatatacaaagaccacctaaggttgggggcagtggcccaccctcacaatcccagcactttgggaggccaacgtggtaggactgcttgaggcaaggagttggagaagagtctgggcaacatagtgagaccctgtctctaccacccaccctgccaaaaaaaaaattcagccagttattgttgctcactcatgtagtcccagctaatagggaggctgatgtagaaggatcgcttgagcccaggggatcaaggctgtagcgagctatgatcacgccactgcactccagcctgggaaacagcaacatcctgttaaaaaaaaaaaaaaaaaaaaaaagcccctagaaattgagaagaaaacgaccaacaaaccaatagaaaaataggaaaataactcaaataattacaaatggctcagaacactgggggacaaaaacctaacctcaaccccattcataataaatgttttctcttttttttttttttttttttttgaaacagaggttttggtctgttgcccaggctggaatgcagtggtacaatctcagctcactgcaacctctgcctcccgggttcaagcgattctcctgcctcagcctcccgaatagctaggattacaggtgtgcaccaccatacccagctaatgtatttttagtagagacagggtttctccatgttggccaggctggcctcgaactcctgacctcaggtgatctgcctgcctcagcctcccaaagtgctgcaattacagccgtgagccaccgggcctggccacgaatgattttttaaagccaaagaaaagagcagtggttagttcagaacctttttggttgccttagaaacttagggtttttgctattacataacattaaaattgccacttcctcctctaaagacctaagtctgagataattagccctcatctttttttcagactgtgacctattcttctcagccccaaaggaaaatttgtttttaagatcatgctttaaaaagtactactggtttgcgcccaatgcttggcaagtaaaaaacaaataaaaagtactattagtttaaaaagttaaagtcttctaaaatcaaactagctaaattcatgtatttttagctttatccaaataaaagatttaaaatgttttctaagcatttgccagtagaaggaatcaattcattttttttttgtttataagatgcttttccagaagttattcttgagattctgagatttttaagcaccgttttcaagtcaataaactgataatagtgttgtacaaattacagcacctcgagctctttgtgggtggaaaggttctctcacatgttaaaaccaagttgatttaatatcatgtcagtgcctcttgctaggattgttacacaactcccctctcttgatttgttgtaatgtaggtttactctggagagttacttcattatgatctatttttaattaattccaatgccctcctttttttttttttttttttttttgagatggagtcttgctgtgtcgcccagactggagtgcaatggtgtgatctcggttcactgcaacctccacctcccaggttcaggcgattctcctgcctcagcctcccaagtagctgggactacaggcacctgccatcatgcctggctaatttttgtatttttagtagagacggggtttcaccatgttggccaggatggtctcgatctcttgacctcatgatctgcccacctcggcctcccaaagtgctgggattacaggcgtgagacactgtgcctggcaaatgccctccttttaatagacagatcaggctgggcacagtggctcacgcctgtaatcccagcagtttgggaagctgaggtgggtggatcacctgaggtaaggagttcaagaccagcctggccaatatgatgaaatcccatgtttactaaaaatacaaaaattagccaggcgtggtggcacgcgcctgtaatcccagctactctggaggctgaggcaggagaatcgcttgaacctaggaggcagaggttacagtgagccgagattgtaccgctgcactccagcctgggaaaaaaaaaaagatcaaatcttatcctggtgttctattatttctggattgtatccttctaggagctctgggaatttagtgatgatgtctgatggcttaatttcctatggaggaaatttcaaagagggttcacctggtaggtgaggaattgtgggatttgtagggcttgtaggggcataggaaaatgggacaatggtagctttaggtgaccacccgtttgtgtatggggatggcagacacaatcttattctctgaatcatcagctctggacataatcagaacaacaacaacaacaaaaactaaagaattggaagtgctttctgcaggtacttaaaggttctctaggtggccgggcacggtggctcatgctggtaatcccagcactttgggaggccgaggcgggtggatcacttgaggtcaggagttcgagaccagcctggccaacatggtggaaccccgtctctactaaaaatacaaaaattagctgggcatggtggtgagcgcctgtagttccagctactcaggaggctgaggcaggagagtcacttgaacctgggaggcagaggttgcagtgagccgagatcatgccactgcactccagcctgggtgacaaagcaagactccatctcaaaaacataaaataaatgaaaataaaggttctccagttttctcctatagatccttcatgaggcttaacttctcctgggaatttgtggataagcatcatttttccacacatactaacacccatcttgtctagataggagcgttataggtttttgccttagacgtttcaagacaccttagtccagaatctattaaaggaaaacatctctggtgtgttttctttccccctcttgtcttgcagcgtcaagcctgccattctaaactctgctgatataaaaaccatttgcccagactcctttgccagttggcttcttgtaaagttctatcaataagcggttctaggaaggaggaaaggaaaagggggctactttttttttttttttttttttgagacggagtcctgttgcatcacccaggctggagtgcagtggcatggtctcggctcactgtgacctccgtctcccaggttcaagcgattctcctgcctcagtctcctgaatagctgggactacaggcgtgtgccaccacactggctaatttattgtatttttagtagagacggggtttcaccatgttggccaggctggtcttgaactcctgacctagtgatctgcccccctcggcctcccaaagtgctgggattacaggcgtgagccactgcgcctggccaaggaggcttctttcttctttgttcctcttgtccatgttgcccagcagtgccagttgactccagcctccaaattattccagctcttctagaagtagactcactgggacatttcagaggtagcagcagcagctgggaggtatttcctcctcagagatctgcacacttctgcagggtctgcggggtccacctaccccagccctcaactcctacattctagtgattgaaacccttcccttcagtttctcagcagccgcttcctccgcttatcatccttaggtgatctcagtgttcccttttgctccaaaacctgtgtaaccaattccctctactgaataccctctgctgaaatccttattgtgatttgttttctcaactagaccctgatcaatgccccagtcataaccagcatgagctctcctcctcatcctgcaactcaggaagtccacagtgagtcagtctaacctgaggtgaaaagagacaactgaacgtttcatgagccttaagacttggagggcaatgatggaaagtatggacaggggccgggtgcagtggctcacacctgtaatcccagcactttgggaggctgaggcaggtggatcacctgaggtcaggtgttcaagaccagcctggccaagatggtgaaacccgatctctattaaaaatacaaacattagccgggcatggtcacgcatgcccgtagtcccagctactctggaggctgaggcaggaaaatcacttgaacccgggaggtggaggttgcagtgagccgagatggcgccactgcactcgagtctgggagacagagcaagagtctgtctgaaaaaaaaaagaaaaaagaaaaagaaatgaaaaaaaagaaagtatggacagacagactcaatttatgatccctccccgagagagacttctgaattcaagctttagggatgaagcctaactgtagcagcctgacaccacaaaagtcaaggtcgcccccaactcacattgaactcagggtccatgttacaaatcctgccaaaaccaggcaaaatattccagaaaaaaatcagactcaaaatttaaagttatgattatttattataacttttacacaggaagaagaaatgggtaaaaataaaatacaactctcctcaatacacgctcaactctcccacaatacagactcaactcccctacaatacagactcaactcccctacaatacagactcaacttccctataatacagactcaactctcccacaatagactcaactcccctacaatacagactcaactctcccacaatagactcaactgccctacaatacagactcaactcccctacaatacagactcaactcgcctacaatacacactcaactctcccacaatacagactcaactcccctacaatacagactcaacttccctataatacagactcaactctcccacaatagactcaattgccctacaatacagactcaactcccctacaatacagactcaactctcccacaatagactcaactcccctacaatacagactcaactctcccacaatagactcaactgccctacaatacagactcaactcccctacaatacagactcaactcccctacaatacacactcaactctcccacaatacagactcaactctcccacaatacagactcaactcccctacaatacagactcaactcccctacaatacagactcaactcccctacaatacagactcaactcccctacaatacagactcaactctcccacaatacagactcaactctcccacaatacagactcaactctcccaatacagactcaactatcccactgtacagactcaactatcccacagtagactcaactctcgcacaatacactcaactctcccacaatacagactcaactcccctacaatacagactcaactcccctacaatacagactcaactcccctacaatacagactcaactcccccacaatacagactcaactcccctacaatacagactcaactcccctacaatacagactcaactcccctacaatacagactcaactcccctacaatacagactcaactcccctacaatacagactcaactctcccacaatacagactcaactctcccacaatacagactcaattctcccacaatacagactcaactcccctgcaatacagactcacctatcccacaatacagactcaattatcccaaaatacagactcaactatcccacaatacagactgaactctcccacaatgcagactcaactcgcacaatacagactcaactctcccacaatacagactcaactcccccacaatacagactcaactcccctacaatacagactcaactcccctacaatatagactcaactcccccacaatacagactcaactcccccacaatacagactcaactcccctacaatacagactcaactcccctacaatatagactcaactctcccacaatagactcaactcccccacaatacagactcaactcccccaaaatacagactcaactctcctacaatacactcaactctcccacaatggagactcaactcccctacagtagactcaactctcccacaataggctcaactctcacaatacagactcaagtctcccacaatacagactcaactctcctacaatacagactcaactctcgcacaatacagactcaactctcccacaatagactcaactctcccacaatacagactcaactctcccacaatacagactcaactctcccacagtacagactcaactctcccacaatacagactcaactctcccacaatacagactcaactctcccacaatacagacttaactctcccacagtacagactcaactctcccacagtacagacccaactctcccacaatacagactcaactctctcacagtacagactcaactctcccacagtacagactcaactctcccacagtacagactcaactctcccacagtacagactcaactctcacaatacagactcaactctcccacagtacagactcaactctcccacagtacagactcaactctcccacagtacagactcaactctcacaatacagactcaactctcccacagtacagactcaactctcccacagtacagactcaactctcccacagtacagactcaactctcccacagtacagactcaactctcccacagtacagactcaactctcccacagtacagactcaactctcctacattacagactcaactctcctacaatacaggctgaactctgcagtcttatttttcttgtatgtccttccaaatggattgtgtctttaaaaaataactaaattttttaatataatagagatggggttttgacatgttgcccaagctggtctcgaattcctgggcttaggcaatcctcccagctcggcctcccatagtgttgtgattacaggtaggattactttgcacctgcatgatcctgcctttttaatacctccaagtttttagtgtctgttttccaaatttttatccacaccacatacgcagagctagtatgagaacttgagtaagtcacaaggtatttctgagaatcagtttcttctggagccaaggtcttttgtgacccaggatacatctggcagagaagaggtaagaggaggcttcatcagaagacagatcagtgcaatctactggatgccgtatctggggacttacggcagcacaaagtcactggatgactccaataagtgagactcttccaagaaaaaagtggggctggcagagcagtgggggtggagaagagccagaaggaaggaactgtcacttattaaggattatttttctcaggggccatgccagctgctctacacatattacttaccatagccactctggtggttacattatgatattcattacaatctttttcttttttcttttaaagacagactctcgctctgccgcccgggctggagcagtggtgccatctctgcttttgcaacttctgcctcccaggttcaagtgattctcctgcctcagcctcctgagtagctgggattacaggcgtgcaccaccacacccagctagtatttgtatttttagtaaagacagggtttcagcatgttggtcaggctggtctcgaactcgacctcaggtgatccacccgcctcggcctcccagtgttctgggattacaggtgtgagccaccaccccagcctcattacaaatttaaaagtgaggtaatgaaagctaactagttcccgcaaggtcacacaagtagagaccgagttaaaaagaaaattattttattttttccctcctgcacgacatgactctgttttgattctcaaactcatgtcagttactgggcctgccaggtgtggtgactcatacctgtcatcccaaagctttgggaggccgaggcgggaggattgcttgcagccaggagttcaagaccagcctgggcaacacagtgagacccccatctctaccaaaacaaattgtttgaattagcagggtgttgtggcatgttcctgtagtcctagcaacctttccacttgggaggctgaggcagaaggactgctggagtccaggagttggaggtcacagtgagctatgatcgcaccactgcgctccagcctggggaacagagtaagactctgtctctcaaaaaaaaaaaaaaaagttatggatcctatagttcaatttcctttttggttttttttttttttttttagatactctcacactctgttgcccaagctgaagtgcagccttgacctcccaggctcaagtgatcctcctgcttcagcctcccaagtggctgggactacaggctgaagccaccatgcccagctaattttttttttcttttctttctgtagagacaaggtctcactatgttgcccaaggtggtttcaaacccctgggcttgagcaatcctcccacctcagccttccaagtagctggaactccaggcacgcaccaccacacctggctaattttgaaattttatgtagagttggattctcattgtattgcccaggttggtctttaactaactcctggactcaagtgatcatcctgcctcagcctcccaaagtgctggtattaaaggcatgagccacgtcgcccagccttatcttacaaactagctcagactagcagggaaaaaagtggttgcaaacatcagtttgccttttaggtctcccctctccagaatcttagcccctttggccctcattgtttcagtagctcactaatgcttttaagtaattttatatttttatctggcttctcccattgttcacaggattgtaaatgtcctgcaatccaatctgaaaagcgtaagttttgtttttcaaatattttaaaaatagttcactaaagctaagtaagtcaaaaattcctcacaatgctattttcctttctttttccttccttttttttttctttctctttccccttccttttttttttttttttgagacagggtctcactgtcacccaggctggagtgcagtggtacaatcttagaatctcagctcactgtaacctccgcctctcaggctcaagcgatcctccacctcagcctcccatgtagctgggactacaagcgtgcaccacacttggtagagaagggggtttcaccatgttgctcaggctggtcttgaactcctgagctctagcaatttgtccacctcagtctctcaaagtgctgggattacaggcataagccaccacaccaggcctcttttacttttttttttttgagacagagtctcgctctgttgccaggctggagtgcagtggcgcgatctcggctcactgcaacctccgcctcctgggttcaagcgattctcctgcctcagcctcctgagtagctgggactacaggcacccgccaccatgcccagctaatttttgtatttttagtagagatggggtttcaccatgttggccaggatggtctcgatctcttgacctcgtgatccgcccgcctcggcctcccaaagtgttgggattacaggcatgagccaccgcgcccggctacttttttttttttttttttgagacagagtcttgctctgtcgcccagtctggagtgcagtggcgcgatctgggcacactgcaacctccacctcctgggttcaagcaattgtcctgcctcagcctcctgagtagctgggattacaggcgcccgccaccatgcccagctaatttttttgtatttttagtagagatggagtttcaccatgttggccaggctggtctcaagctcctgacctcaggtgatccacctgcctcggcctcccaaagtactgagattacaggcgtgagccaccgcgcccggccctacattttgctttcaaaattttgggggcggccagagagacagagcgacacactgtctcaaaaaacaaaacaaacaaacaaaaactaaaacaaataaaatctttttcgagacagggtctcactctatcacctaggctggagcgcagtggtgcaatcttggttcactgaagccctgacctctgggactcaggcgaccctcccacctcagcctcttgagcagctgggaccacaggcgtgcacccccacaactggttaattttcctactttctgtagagatggggtttcaccatgttgcccaggctggtctcgaactcttgggctcaagcgatctgcctgcctcagcctcccaaagtgctgggattacagtcctgagccaccatgcccagccccttttttctcttaatgctgaaaaagctttcctgaattataatttttaaaacttaaaaggcagaaaagggccatctacagtggtgcagactgagatttataagcttcctttatcttgcaatattttaagaacattttaagttttttttttttttttgagacgcagtcttgccctgtcgcccaggctggagtgcagtggagcgatctcggctcactgcaacctccgcctcctgggttcaagcgattctccggcctgagcctccccagcagctgggactacaggcctggcaccacgcttggctgattttttttttgtatttttagtagagacggggtttcaccacgttggccaggctggtctcaaattcctcacctcaagtgatctgcccacctcagcctcgcagtgcagtgttaggattacaggtgtgagccactgagtccagccacatactcccttctcaaggtgttttctgggtattcaccctgattttgggggcgggttggagttatgaaaaacaacatcacagacttcctataaagaccttttttttgagatggagtcttgctctgttgtccagtctggggtgcaatggcgtgatctctcggctcactgcaacctccacctcctgggttcaagtgatttttgtgcctcagcctcccgagtagctgggactacaggcacccgcctaatttttgtatttttaatagagatgggatttctccacgttggccaggctggtttcaaactcctgacctcaggtgatccacctgcctcggcctcccaaagttgttgggattacaaggcatgagccaccgtgcctgaccccccgaccttttttgtttttgtttttttgaggcacatgtcaccatgcccggcttatttttattttgagacaggcgtgagcaagcacacccagccaaaaatttctcctacatgtcattctgcatacatgtgaagacagccttaagaaattcctagaatagtcaaacgtacctccagagattttcaattatctattcataccaagcaatgtataagaatgcctagttcctcgcagtcttgccaagattaaaacaaaacaaaaaattcccttatctttgctaatctgaaggatgaacaaacttatgagtattagcataagattatgcatctcttcacctaatagttcagaaccggttatagttactttcttgtgaatgatgtttcttgggaacatacgcatttctagttctcctattgaggacttttcttttttttcttttttttttttttttgagacggagtctccagtctgtcacccaggctggagtgcagtggcacaatcttggctcactgcaacttccgcctcctgggttcaagcaattctctgtctcagcctcccgaatagttgggattacaggcacacgccaccacacccggctaatttttgtatttttagtagagacggcgtttccccatgttggccaggctggtttcaaactcctgacttcaggtgatctgcctgcctcggcctcccaaagtgctgggattacaggtgtgagccaccatgcacggccgagttattggtcttttcttaatgaactggaggatactttacataaaggaaattagctctttgtgatgaactgcaactatttcttcccaagtttgccacagcttccaatttcccttgatggtagtttttgttatgcagaacttttaattttcatgtagctgatttttacatatttttaagttgtggtaaaatacacataataatccatttttatttttagtattttatttttcagattctcagcctctgcacagccttagtactccctgagaaattcagtgtttgcatatcctttccacaaaaatgagaggaaaaaggaccagtacctgctagtgactgatacatttattagtttctaacaaaaaggcatacatggtaggcagagtagaaatactaacagaaattagtttatcttgaaaccaattttagtcaggaagacttcttcacagagaatgagctgaatatataaatcccaaatatatcacaccatatatgtgatatatttacacctaaatatatcacaccctcctttttggtcacagactattccaggaagattaaatagataacgtttaatttgaggcattcaagaatgtccaccctaaaactgaaagtgaaattgctcttagagaaaaattggtttgatgagaagattgatcttagcctgtctcagacaaatttggtttatttatttttacttaacgacccatgtgatagtatagttgcaagctatacttcatttaactacaatcattactcagaggacaatcaccttaagaggcaaattaagttttaaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttctatttctgttcataaactcaaataaaagcagtatcaacacaaatgatcatataagaaaacacgtggttatgtttcaggttccacaacataagacactgtgaggtaactctcctgtaatacattcccatttttttctggaatagcagatgcatagaaatgcaggtttccaaaaattcacccaatttagtaactaattttgattctgatgcctgatagtagggtgtgaaaagctgtaaaacccaaatgtttcctgtgttctttcacaaggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggaggcggaggttgcagtgagctgagatcgcgccattgcacaccagcctgcgtgacagagcaagactctgtctccaaaaaaaaaaaaaaaaaaaaaaaaaaaaaaaaatctgggatttcccacatatgaatatgaatccaaattttgaaactccgtctaaaaaaaaaaaacaaacaccaaaggaaatgctacaatgctgaaaattgaattaaattggagatggaaattagattactttaggaaaaccttttgagtactctgtaaacattggacaatagcaagaaaatggattttaaaccctgcatgggttccttaatcactcagaatagtataatcttgctttgattaccagtcacgacaaaaaggtgagcaaaggccataaaacatgcagtttttggaaagacaatggcacttgaagatttcctggagttggccaaagcttaagatatctctaagaattgtaaagcttaatacacatctgttattaagaagggaaacgacaggggacccctgcttaccgctgagctgtgcagaagctcatgtgtctatgcagtccttacaatcacacagaccttcattaaggacaatgagtgtgcctagagagcagcatgaatgacacatggatgaagattccatgataggaaagagcttcacattccagctttactagatcacaaagcactccctttaccaggccttactttgtgcatctctgaaacatctgaaaaacacttttctgtgaaatgctaggctgtagggagtgagcacttttggataccttacagtgatctctagtagaatttggcatctttcttctattaactgactgcttcaactgcatctttaaagacacttgcctatttttgtcccttgagcctctctctggtgttggatgctttgtgtgagtttgccttttgaagttcccatctttgggattcttcctctgtccatttagcactttgtctggaggggaggatgtagcgcgtaagtgatactcatctggggatcctttttgccggtttggcaccatttgctctttatccacctccttctgaagttgtaatgccaataacctgtcctgttcttcttgtttatgtctctcaaacagtagatgctccaaatctatcagtttttgggtaaagtttatttctgtttcctcttgatctggggaagattcgggggacacttttcttctttttgcagaaaagcatggatccttgactgcttcaaaggaagattcttggttttttcttttggaaatctccttactgatcagtaggcacgactcttcattttctgtctcacctgtgttgtttccatttgtctgtgtcacccctgatgtgggggcgcacccactttctgttctgccacaaggcataactgcagtttctttcgagtagggaactctggttttaggtcgctcgtgacttaagacacataactctttcccatgattgcttggtcttgttttgacgtttccttcatggtaccattcggcaccacaggcacataaccatggcataggggactctattgaagaatctgcaccttgttctccaactccaagggatatctgtggagaaagtgtcggcatatcttctatttctgtgtcttgccctgttgggcttttcctatcactactgtcaatgtcctgtagaaaacagaaaaagactgagtgaaccaggggaaaatatcaaatcataagatgtaagtctaattacactgatactacagctggactgtcactatacattattattactaataaggtatatatttctttctttcttttctttttttttcagagtcttgctctgtcgcccaggctggagtgcagtggcgcggtctcagctcactgcaaccttcacctcccaggttcaagtgattctcctgcctcagcctcccaaataggtgtatatttattcttaatagtatttttatttcatgggcaaatttagattaagctattacttcattttcactcccatgaaaacctacagattaaaacccacagactagattccaaatatggccaatagctggtatcaggacctgaccttctttcaccttacaaaggtctgccagcataggggtttttaactcttttctctaccgtggaccctccttttggcatttaggtgaagcttacagaccacttctgagaataatgtttttaactaaaaaattaagatatacagtagctttacaaaaggaacaatttatgttgtaaacacaatcattaaaaggttcaaaaaaatgtgaggtaataatgtgcatctataatacagtaaataataggatctaccagccagtctaataactcataatacccaattatctgtgtcacccctgatgtagtacacccactctctgttttgccacaaggcacaactgcagtctaataccaatgtagagataagtataaatgatatttaaagatatctgtaacatggctgggcacggtggctcatgcctgtaatcacagcacttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaaatacctagtgtttggaagataaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatttttttttttttttttttttgaggtggagtctcactctgtcatccaggctggagtgcaatggcgacatctcagctcactgcaacctccgccttccgggttcaagcaatactcctgcctcagcctcctgagtagcagggactacaggtatgtgccacacctggctaattttttttttttttttggtatttttagtagagatggggtttcaccacattggccaggctggtctcgaactcccaactttctgcctgcctcagcctctcaaagtgctaggattacaggcctgagccaccgtgcttggcctcccatcttgtaatattctttttttttttttttttgaaacagagtttcactcttgttgtccaggctggagggcaacggcacgatctcagctcaccgcaacctctacctcccgggttcaagcaattctcctgcctcagcctcccaagtagctgggattacaggcatgcgccaccacacccggctaattttgtatttttttgtagagatggggtttctccatgttggtcaggctgatctcgaacccctgacctcagataatccacctgcctcagtctcccaaagtgctgggattacaggcgtgagccaccgcattcagctccatcttgtaacattctaagtgaagctggtgccaggtataacctattcagttttgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaaggttgtctggtttgctgcttggctgttttatcagagtgtatctcatttccgtgcttcagatattttggtcaattccaggacaaaacttaaatgattgagtattgatattttagtgaaaaacagaaaaggaagtaaaagtcaaatctaaatattttttcttttttttttttttttgagatagagtctcgctctgtcacccaggctggagtgcagtggtgtgatctccgctcactgcaagctccgcctcccgagttcacgccattctcctgcctcagcctcccaagtagctgggactacaggcgcccaccaccacgcccggctaatattttgtatttttagtagagacgaggtttcaccgtgttagccaggatggtctcgatctcctgacctcgtgatccgcctgccttggcctcccaaagtgctgggattacaggcgtgagccactgagcccggctaaatatttttttttcttttcttttttttgagacggagtctccctctgtcgcccaggctggagtgcagtggcgcgatctcagctcactgcaacctccgcctcccgggtttaagcgatttttctgccttagcctcctgagtagctgggattacaggcgcccgccaccacgcccggctaatttttgtatttttagtagagacgggtttcaccatgttggtcaggctggtctcgaactcctgacgctcaggtgatccgcctgtctcagcctcccaaagtgctgggattacagccgtgagccactgcgcccagcgtaaatatttcttaattcttgaaaaaagcttaaaaaagcagatagcatcaaaacaatgcaagactctatagtcttcccaaaagtaatgaaaatgatgctttaaactaggagaaaggatatgttagtttcttctttatgctggaaatgttggctgttcacgacattttaaatctctactattgggaaaaagtccatgattaaattccttactattctggtatagagatgttatcatacatacttttatatcaactctcttcttttttttttttttctgagacggagtcttgctctgtcacccaggctggagtgcattggtgcaatctcggctcactgcaaccccgcctcccaggttcaagtgattctcctgcctcagcctcctgagtagttgggattacaggcatgtgccaccacgtccagctaatttttgtatttttagtagagacggggtttcaccatgttggccaggctggtctcgaagtcctgacctcaggtgatccgcctgcttcggcctcccaaagtgctgggataacatgcgtgagccaccgtgcctggccctcaactctcttcttagaaacacatatctttacatttctttctttttttttgagacagagtctcactctgtcgccaggctggagtgccgtgacatgatcttggctcactgcaacctccgcctcccgggttcaagtgattctcctgcctcagcctcctgagtagctgggactacaggcacacgccaccatgccctgctaatttttgtatttttaatagagacagggtttcaccacgttggcctggatggtctcaatctcttgacctcaggtgatccgcctgcctcggcctccctaagtgttgggattacaggcgtgagccactgcacctggtcatatctttacatttctaagaatcttcaatataacaggctgtttgccactgaaaacactacggttttaatagaatggaaaatgttataaaagaacggggaatagaaaaggcaggctacaagatggtaggtatagtttaaaaattgtaaaatatccaaacatgcatataactatgtttacaaatggcagaaatttcccaaaatgttggttgtctccaaatggtggaaactttgggtgattttcaaagagcagctagccatggcttttagaattagagaaaaaaagtgactataaataacagacaaatccataagttacactgtgtcaaaagcaccaacaagtagcatatggaacaatcaaacctaaacaaagatctcatataaagaactaatgaatattccttatgggcaaacaagagtacctaacccatatatttagttatatcaatctatatatttactctgttaactttgaagaacaagaaccaaattttcagttgaaaagaagcttagtctcatttagtttctttaggctgaagaattctttctgtcaatgctgatgcgggaccactacttacgaagcataccagtaccaaagtatcactgttataacagttgttttgacgttcataagcagagaacagaatgttattacttatccaacacaatcactgaagattcattaactctcttggatattccttatttataataaccaagtaatatatgaatacatgctcattctgaaaataagcagaactggccgtggtggttcatgcctgtaattctaacactttgggaggctgaggtgggaggatcgtttgaggccaggagtccgaaaactggacaacacagcaagacccatctctacaaaaaattaaaaagaaaaattagctggacataatggtgtgtgcctatagtcccagctactctgaaggctgaggtgggaggatcgcttgagcccaagagtttgaggctgcagtgagctattttcttgccactgtggcctgggtaacagtgagaccctgtctcttaaacaaaacagaaatacaggaaatatatgtcatcaaccctttcccttcccatgttttaagaacttttttttttcttttttccttgagtctgaatttttgggatccattcccatttgcttccttttatgttttaaattaagtttagcctaaagctgcctccttacgtattttaagttcagcccaaagatttctctgtatatagtgaactacagcctaaagggaggtgtgaacagcctgtaaactactcttgtgccagtcaccaagctttggccaaagggggccaactgttcaaatcatgttcaaataaggcaaatgccaaactgtaaccactctggctgtctctgcccctcatttctgctttccatacatcacgttcccttttctgtctgttaatcttcttccgacatgtggctccacgggagtcgctctcggcctactctggctcgagaggctgcccaatttgtgaattgtcctttgctcaattaaactctgttaatttgtctaaggttctccttttaacatatgtaaccaattttttaaaaatatgatttctatgaaatacacactctttttgattttgtttattttagttattttattttttgggggacagagtctcactctatcgcccagactgaagtacaatggcacaatctctgctcactgcaacctctgcctcccgggtttaagcaactctcctgcctcagcctcccaagtagctgggattacaggcatgcaccaccatgcccagcgaatttttgtatttttggtagagacaggctgatctcgaatgcctgacctcagaagtattgtatttttggtagagacaggacagccaggctggtcttgaactcctgacctcaggtgatccacccacctcggcttcccaaagtgttaggattacaggtgtgagccaccgcacctggccattattttatttatttttttttgagacggcgtctcactctattgcccaggttggagtgcagtggtgcagtctcagctcactgcaacctccacctcctgagttttaagcaattctctctgcctcagcctcccgagtagctgggattacaggtgctcgccaccacacccggctaatttttgtatttttagtagagatggggtttcgccatgttggccaggctggtcttgaactcctgacctcaggtgatccacccgcctcggcctcccaaagtgctgggattacaggtgtgagccaccgtgcctggcttcattattttttaaggcagggtcttgctgtcaccaaggctgaagtgcagtagcaccatcatagctcacggcagccttgacctcccaggttcacgtgatcctgccacctcagcctcccaaacatctgagaccacaggcacaccacgcccggctaatttttgttattttttgtagagacagggtttccgcatgttgcccaggctggtctcaaactcctaggctcaagtgatccacctgccttggcctcccaaagtgctgggattgcaggtatgagccaacacacccagcctcacgcttttttttttgagacggactatcgcccaggctggagtgcagtggtgtgacctcggctcactgcaacctccgcctcccaggttcaagcaattctcctggctcagcctccccagtagcgggattacaggcgtccgccaccacgcctggctaatttttttgtatttttagtagaaacggggtttcaccatgttggccaggctggttttgaactcctgacctcaagtgatctgcctgcctcaccctcccaaagtgctaggattacacgcataagctactgcgcccggcttgtgatttgcttttttcactaatgtcttaagatctttccaagtctgcctcatgaaaacaaagtttatgagagaacagtcatacaatacatgtaagaatcacagtacagcacggtcacggggagggggacactgactggaaagggaaagggcacaagcaaacctttgtaaatattccgtcttcatctggtgggtggtttatacacacacaaaaattcaccagaaagtatacttaggattggtgcaccgtctttttaaattttttactttttcttttttaccctgtcttatggtgccgaagactggtgcactttaaaatatatgtttgctgctctgtggtccattaaaaacaaaacaaaaaaatgtgttattcttctaaaaagtttaaaaatctgtattaccatgaaagcccatatgcttattacttggttgaagggaaaagaaatcattggtttgaaagtctcctatggggcctcgtcatctcccacctcatactatcctgagtttcttatatcttactttttaaaacagatttgccacacttttgcatctctaaacactttattgattagtattgtgtgattctgagcgagactccgtctcaaaagaaaaatttgaaaagttggaattctgattcgaattgcactgactctatagatcagtctgaggagatctgaccattttgtagtattaggcatcttctaacccatgaatattgtatatttaatataatacaattttctccacgggtcgtacagatttttatttttctgagacatggtcttgtctgttgcccaggctggagtgcagtggtaaaatcacagctcactgcagccgtaacctcccaggctcaagtgatcctcctgcctcagccacctgagcagctgggactacaggtgtgcatcatcatgcctggttaattttttaatttttttttaagagatagggtctccctgtgcagctcgggctcgtcttgaactcctgggctcaagcaatcctctcgcctcagtctcccgaagtgctgggattataggcatgagccaccatgcttgcctcagattttaacacatttatttttaagtacttttattttctgatactactatcgacagagtatttttaaagttacattttacaattgactttttgtacagattttatatctggcaaccttgctaaactcttcattctaaaaatgtacctctgactttttgggttttctacatagataattataccgcctctgaagaatgatagctgctttttccttcctttccaggctgatatgttttatctccttttattgtgttactgtgcagactaaactctccagcatgagtctgaatgcaggtggagagtagcaggccacccttgcgtattcctgaccttacaaggggaatggcggggcgtggcggctcactcctgtaatccaggcaccttgggaggcccaggcgggaggatcacttgtacccaggagtttgaggttgcagtgggccatgatcgcaccactgcgctctagcctgggtgacagggcaagaaagactgtctggaaaaaaaaaaaaaggaaataatttcgatgttccactatgaagtatgatatgtgatgtaagattttggtagatatccttcaacaggttaagaaagtttctttctgttaccacttcattaagaattatcatctcgtgtatttcatatttatacagctaattgaataacttacagtgattcattttctaccattaaaccagcaatgtattcctggaattgtctttttaaatacgttttcagctgcgtttttttttttttttttttttttttttgagatatgatcatagctcactgcagcttcgacctcttgggctcaagcaattctcccacctcagcctcccaagtggctggggttacaggcatgtgccactgcatttggctaatttttttattttgtgtagagacagggtcttactatgttgcccaggctggtcttgaactcctcctggcctcaagcaatcctaccacctcagacctcagcctcccaaagtgctgggattataggcatgagccactgtccctggcttttttttttttttttttttagagacaggatcttgctatgctgtccaagctggtcccaaactcaaactccctgggcttaagcaatcctcctgcctcagcctcccatgtagctgggattacaggtacgtgccacaacacctggctgccctttcttcttttctgatacggcacgtaaagccttctaaataccactttagccacataccagttttcatgcatattttcagttctgtatttccaacaaaatttactctttaatcaacaagttgtttagaaatttttcttaattttaaaactatataatcctgttattcatttttaaacttttgaattgaggtgtaattcacataaaatggaatgccacattttgtttacccattcatttgttaatggacatttgggttgtttctacctttcggttatttgaataatgttgacacaaatattcatgtacaagtatttgtttgaatacctgctttcaattcttttgggtacatacctaggagtggaattgctgggtcatatgctaattccgtttaacttttcaaggaatcaccaactgttttctgcagccacgataccactttacattcctaccaagcaatgcgcaaggattccaatttctccacatctttgtcaacacttattattttccctttttgtggattatagccatcctaatgggtatgaaatgctatatcactgtggttttgatatgcatttccctaataactaatgatgttaaacatattttcgtgtacttattggccacttgtacatcatgggaaaaatgtctactcaagtccctttgtccagtttttaattatttgtcttctgttgttgagttataagagttttcatatattctagaaaacagactttatctgtttttaatattgttacaactttaatccatcagtttctcaatttttgcttttaaatccttagtttttcttgtatctctggtaattttttatttttatgtatttcaaagtatatatttagatatataaagattcatgagttatagccttaaacagcatattgtatcaatatgaaatacttctgcattttagcggttttctcatttttactttgcacattatgagtactggcgacactgatattgtcacatctttttttttttttaatagtacctccctcatttaacattctcttctcctaagcttcctcccacctcaaatacaaaatttcaacaaatcttggaaggagatgagttacctgcacatatttcctcagttgaaccagaagtccttatgtatttttcaagtctagactgtggtttttaaacttttccaactgtgagttaccatgggaaagctgatgtttgcgtaaagccaccaactccacctggcacctgaccctggaggggtgttgtggtgaaactcaatcacgccacctttgtctacctgactcatgcattttgtgtaatagagaagaaatgacaaattgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtgtgagtagctctctccttttcaatttacctcaacctcagactattttcatacaaagttcacggaccaaactttgagaatcagtagtagtctatatgaacagaaaacactggcatacagtaggaggtcaacaaataattcatagtcatgttcacttacttctgaatatctccagtgtttctttgtttgttcttacttttcttttcagacttgggtgtaactggatcagattttctggaattcaagggagaagccgagatacttccctcacagaaattgttcttcaacaatagaaaaagcataacagacattatgagagagaactttatgataaaataagctattaatttgactaattcagaaatccatagcatttttcagaaattatagttatatttaaattctgtacatctcttgaagaatattgaccatgcaaaaatcagaataaactatgttcatccaagttggtctaaattaattacatttttactgtacatcaagcacaaaataaggcataatactaacctcattagctgataattcctgttgatctttctttcctttttttttttttttttgagacgcagtctcgctctgttgcccaggctggagtgcagtggcgcgatctcggctcactgcaagctccacccccgcaggttcatgccattctcctgcctcagcctcctgagtagctgggactaccggcgccctccaccatgcccggctaattttttgtattttttttagtagagatggggtttcactgtgttagccaggatggtctcgatttcctgacctcatgatctgcctgcctcggcctcccaaagtgctgggattacaggcatgaggcaccgcgcccggccttttttttttttttttttttttttttaagacagggtctcactctgtcgccgaggctggagtgcagtgtagcaatcatggctccttgcaaccttgacctcccaggttcaagtgatcctcccaccttcacctcccaagtagctaggactacaggcatgagccaccaggcttggttaggtgggttgtttttgttttattttgagacagagtcttgctctgtcatccaggctggactgcagtggagtgatcatagctcactgtagcctcaacctcctgggctcaggcaatcctcccatcttagcttctcgagtagctaggacacaggcatgtgccaccatgcccagctacttttttttaaatgctttgtaaagatgaggtctcactatgttgcccaggctggtctccaactattggaatcaagtgattcccccaccacagccttccaaagtgttcggattataggtctgtgccactgtgcccagcctgttgatttttctaataaatacttttatataattacttttatctatatggacatattcagagagctgtggatatacccaaaagaatagttttatgtaataatattttagttctggactttaagggcgtattaataaaaatcacaaatatttacttgctgtaccagtctcgtaagtttcttactaccctaatggaaaagttcatatatggtgatggtgaatatttggccttaaaccaccaaactttcataaataaatagaaaattattctaggttgggcatggtggttcatgcctgtaatcccagcactttgggaggctgaggtgggtggatcacatgaggccaggagttcaagaccagcctggccaacatggtgaaaccccatcggcactaaaaatacaaaaattaacaggatgtggtggcggcacctgtaatcccagatactctggaggctgaggcaggagcatcgcttgaaccgggagttgaggttgcactactgcactccagcctgggtgacagagtgagactcttgtctcaaaaaaaaaaaaagttaaaaaaattattctacagtatcaataaatctactcttataataccatgggaaaactagatatacttcttccctattccatttattattccattggtcaatgacttttatttagtttcctgattgtgtatttctaaagcgattctacttaaaaaagacacataaaaaggggcatataacccaaaatttgggtacattattattaatggtaggcctctcaaaaaagaaaaaaattcccaattctgcgtatactcattttgctaagtgtatatacatatatatttttttattctattgaacttcccatgattcaatggtaagtgtatgttaagatattcgttgtttgaaagctgaagaattgttttcacaggctctcaaacctgaatgtttcacacttccctacatgcctctgaagattgtattccctaggtcccatccctagagactctgacttaatagatttggagtaaatatgagagtttgtatttcaacagcattcccaggttactctgccaggctcgttcaaaccactgggccccacagtaccctctgatcttaaagtatgtgttttatcacacaccatttaattcattttcttacaggcagcaatttaactacaggaagcagaacatccaagtttaatacattatctaaaaatttaatgtgccttactttcaaaatgtgatttacatccataaaatggaatattattccactctttaaaagaattagattgactacatgtagtaatatgaaaaatctctacgatgttatcaagtggaaaaaatgtaagcagcaaaacagtgtgattgctttatataatcctttttaggtcaataaagaaaaaaagcttttttttttgagatggtcttccaggttgaagtgcagtggcgagatcagctcactgtaacctcaaactcctgggctcaagggatcctcctgcctcagcccctcccagcaggtggagctccaggcacgcaccatcacactcggctcattattaatttttctgaagaaacagggtctcactttgttgcccaggctggtctcaaactcctgggctcaagcgatcctctcgcctcagcttcccaatgtactgggattacaggcccgagccatcgcaccctggcaagaaaaaagttgtaagaaactgttaatagtggttacctttggggatagagactgatataaatggaaaaggaacgggagtggagaggtggaagaaggaaaaaggaagctttcattcttcactgaatagctttcctacatataaaaaagttgttaaacaacttgcggtggctcacgccacaaacccagcactttgagacgccgaggcagatggacggcttgagcccaggagctcgacaccagttcaggaaacatggcaaagccctgtctccacaaaaaagtagccaggcatggtagtgccagcctgtagtcccagctactcgggaggttggaaggatcaccggagcccggccgtcgaggctgcagtgagtcgtgattgtgccactgcactccaacctgcatgacagagtaagacctgtctcaaaaaacaaaaaaccccaaaaacctggattagagcaaatatgtaacaatatgcaaaacaattttactttaagtaaagcaaaaatgttatcaatagcttctaattatggcaacgccatctcttctgttctttgaaaaccacagtcaaagcaatcggaatgttaatagttagctttccgtatcagcaggttccaaacactcaaatccaaccagcctggggtggaaaagacaatatttgtgggatgcagaacctggaaatacaaggagctgactcttcccatgagcgggttctgcagcagcgcataccaagggatgaccataccttagcgttccctcctaaaacttacaatatcaatgcttagctttcttgccagttcctcatcacttttcagttgttcttccatcgctcttcgccttttttctgcctgtcttttttcctcttcttcctcctctgccaacaacctctgtatgtattcttcactggctttgttttcttcttcctcgctggcccgtcgctctgccgccaccttaaaagtgattaataaagagcaatccttctctgaacgttttggtatacttgcaatatttcataacaagaatagaaaagtagaaaaagaacaaattggcagaaatttaaatgatctcaaatgaagtacaaatctggagaagtagattcctgcaagatagctgtcccatctcagcctcccaaagcactgaaattataggtgtgagcctccacacctagcctgagatgtattacaagtgaaaattatacacaaaattttgaagactaacaaaaaaagagaaaaatctctatttatgtataacttcatatgtaattaaaacataatgcttcactataaacactgctttttaggtacttttcctatttaggaacttcacagctagccctttaacctttcctcatctaaactcacactctaccacccttttactttaagctcaaaactttggggaaataaaaatatatcctggtatggattaaattaggaaaaagaagaattaaaaaattttcttcatatgtaaatgcttagggaacactatcacataagagcattaattatgtagaagtaaattacagcaaaaaacaaagcccttataaagtacattaaaattatccatattttggccaggcacagtggctcacacctataatcccagcactttgggaggccgaggcgggcggatcacaaggtcaggagatcgagaccatcctggtgaacactgtgaaaccccatctctactaaaaatacaaaaaaattagccaggcgtagtggcgggcgcctgtagtcccagctactcgggaggctgaggcaggagaatggcatgaacccgggaggtggaggttgcagtgagccgagattgcgccactgcactccagcctgggtgacagagtgagactccatctcaaaaaaaaaaaattatccatatttcaagatatactagttatataagcacaaaaaactaaattaaaatctgaaactaaaaacacagcagagaaatattccaaaaaaaaaaactatttagcacctaccttgcttatttcctcttcatattctcttctcagttccccaggtttactgagcagacgaactggctgatagtcatcagctatttcatatcaaaaaagaaaataacattataggcaacacaattttatggtaactttggtcttccattaaaacgaaaaattaaaatatacaactattaataactgcagcaatatctccttttggaattccatttttaacatttattttatttatttattttagatttattttatttattttttttgagacagagccttgctctgctgcccaggctggagtgcagtggcacagtctcggctcactgcaacctccacctcccaggttcaagcgattctcctgcctcagccttctcctgagcagctgggattacaggcatgcgccaccacacccagctaattttttatatttttggtagagtcagggtttcaccacattggccaggctggtctcgagctcctgacctcaagtgatccacccgccttggcctcccaaagtgctgcgattacaggtgtgagccaccacgcccggcctggaattccattttgtgaggccagaggtttagggttttgggtttgaaatggcatatgaatgcatatacttaacccttcctctaaactccattaaaataacagtaaaggaatttttaaaaactgtaatcctacaacagcagaaattagcagaggaggttaactgattaaaaaaaaatgttttttttttttgagacagagtcttgctctgtcacccaggctggagtgcagtggtgcaatctcagctcactgcaacctccgcctcccgggttcaaacaattattgtgcctcagtgtcctgagtagctgggatcacaggcatgcccaaccatgcccagctaatttttgtatttttaatacagaccggtttttgccatgttggccaggctggtttcgaactcctaatgtcgggcaatctgctcacctcagcctcccaaagtgctgggactacaggcgtgagccaccgtgcccggctccagttaaaaaatttttaacaaatttctagaaaatgggaaggcaatgaaatagagataattgatacagcagaaatgaaggaaaagaaatccttgaaagggaagactacagctgaggtagaattagaagggaatctgcctcctatttgcctagagagaggctcatagagtccagagtgagtaaccgtgggactgaaaacagaactcgagatttataagctgttaaatcagaatcctcgacttaccggcatttctccctggatatgggtgcaggtgcacacacgcatatttctttaaagaaacagatctagagagagccagagcagctaatgtaataggtggtgacccagagcaaagtcctctgcgatcgggcagttagggatggcaaagcacaaaggccaggtttccatcggcttgaactcaacgtctgcccatcaccaatacccttccacatacacagagcttttctcctgggcctcattctcaaacctaaaagctaatccaaggatcgtcagacatttgaaatacatctgcaggactagggaaacagtaagctatacaaagagaaaaaatcatcaccctggagttgaaagataattctgggtcagaaaataacctaaatgtgggtatgtatcctcaacaaatctgatgagaattttattctataaaacaagacactgttttataaagtgtaaaaagggaacatccaaaaaagagaacgcatctgtctgtttcaaggggcagctgctactcaactccagctgactacgactaccaggaaactcaggcctgtccgtgccatattttttgctttctcaagaaaatccagaggcggcaggggtggatggtgagagatgacttcatgggtacaatgtacattatttgggtagcagataccctaaagagccctgacttcgccactgtgcaatctatacatgtaacaaaattacccttgcaccccataaatttatccaagtaaaaagaaaaaaaaaaagaaaatccagcaatcaagatgttaatatgaaatcttccaacttaaatagtggcattggatgggtcacaaaaaacatgcacacaggattcctatggcctgcaggccagcagtttgaaaaatctgcaacagagagactaaaaaacagtgatgtaactccaaaacaattagggatgcagtatgctgaattctcatttattttagtcactaaggaggatctattcaagacaatacaatggtatacacaggagagacatatataaggctccttaaaaagtagaaggataatcagctggcttaaactgagacctagatcagcaagtcttaaagtagaatctacgaaaccctggaggtatctgagactttttttcagggaaactgcagagtcaaactattttcatttaaaaaattaaagtaagctgggagcggtggctcacgcctgtaatcccagcactttgggaggctgaggcaggcggatcatgaggtcaggagttcgagaccagcctggccaatatggtgaaaccccgtctatactaagaatacaaaaattagccaggcgtggtggcacgcacctgtagtctcagctactcgggaggctgaggcagtagaatagcttgaacccgggaggcggaggctgcagtgagccgacattgcaccactacactccagcctggacgacagagggagattccgtctcaaaacaaacaaacaaagaaacaaacaaaaaacccaaataaaacaactgacagtaggccgggcacagtggctcatgcctgtaatcacagcattttgggaggccgaggcaggtggatcacttgaggtcaagagtttgagaccagcctgaccaacacggtgaaacccgtctctaccaaaaaatacaaaaagccgggagtggtggcaggcacctgtaattccaactactcgagaggctgacacagaagaattgcttgaacccgggaggcggagcttgcagtgagccgagatcacgccactgcactccagcctgggcgacagagggaggctccgtctcacaaacaaacaaaaacacatgttcaacattactagtcattagggaagtgcaaatcctgagtacggagataccgcttcagaggacagccaacacttggttttttttttataatagtcatccattaagatatatacacacacataatggagtatgcggccaaaaaaggaaatggaatggacacgtgctagaacacgatggaccttcaagacactacgctgcgtgaaacagccagtcaccaaaggacagacactgtgtggggttccactcgtacgagacacctagagcaattaaacccgtagaggcagaaagaatggaggtcgccagcagccaggggaggggtgaatggggaattaattattgtttaatgggcagtttcaagcgtggaagatgagaaagttcagagatgaatggtggtgacggctgcacaaaaacatgaatgtacttcatgtcacgcaactgtccatttaaaaatggttaacatggcggattttatgttatgtatcttttacaataaaactggaaaaaaagtaaatcactttacacattagatacaataaaatagtagctaagaggctgggcacagtggctcatgcctgtaatcccagcactttggaaggctgaggcaggaggaccacttgagctcaggctatcaagaccagcctgggcaacatagcaagaccccatctttgttcaaaaaaattttttttaagtagctaatttaggaaaacaataataagacagatgtattatactagaaagcaaaacatatcattaagcagaattaaactaagcatgtgtggtactgacacagctactgataaagagatagttaaaaaataaaaagcccaggcaaggtgccatggctcatgcctgtaatcccggcactttgggaggtggaggcaggcggatcacttgaggtcaggagttcaaaaccagcctggccaacaaggcaaataaccctatgtctactaaaaatacaaaaattagccacgtgtggtggtgcacgcctgtaatcccagctactcaagaggctgagacaggagaatcgcttgaacccgagaggcagaggttgcagtgagccaagatcgcaccattgcactccagcctgggtgacagagagagactccatctcaaataaataaataaataaataaataaaataaataaatagccccaaattgctctggaaaataagcatatgattagtgaaatagtacgtatatcaatgtggctgtattactaccaagtagtgtggctattaagtggcaatcaagggcagggggagttaagatgcctacctcatacaatactcgaattcaaggtggattaaaaaatggaaaaaaacaaaactataaacgactaagaagaacatatgagataaattccaaaacaattaaaacttccatgtgatgaaagacatcacaaagttaaaaacaaactagaagttatttgcaaatacataaatcaccagagaattagtgtccagaatataactagaacttccacagatcaattaaaaaccacaacaggcaaaggaaaggcacgtgcgatttacagaagatgcccaactacagcaagcagagagctgaacttttgttaaaccgtggaatgacagatttttaaagtttacttatttctacataaactgaatctaaattaagatcagtgagttattcaactgcagacacaagttaaaattgtcttcatttgcctttttcttttgtttttggaaacaagatctcactcttgcccaggctggagttcagtggcgggatcatagctcactgcagcctccaaccccttggctgaagcgattctcctgccctagcctcctgaagcactgggataacaggtgtgagccactgcatccagtccatttgctatttctttttcttctttgacggagtttcgctcttgttgcccaggctggagtacaatggcgcaatctcaggtaactgcagcctccacctcccgggttcaagcaattctcctgcctcagcctcctgagtagctgggattacaggcatgtcccaccacgcccagctaattttttgtaattttagtagagacgggggttttaccatgttggccaggctggtcttgaactcctgacctcaggtgatccacctgccttccaaagtgccaggattacaggtgtgagccaccgtgcccagccttccatttgctatttctttctttttttaaatttatttttttttttttttgagacagagtctcactttgtcactcaggctgcagtgcagtggtgcaatctcagctcactgcagtgtccacctcccaggctcaagcaatgctactgcctgagcctcccatgtagctgagactacaggcgcccaccaccacacccggctaatttttgtattttttgtagacggttttgccctattggccaggctggtctcacactctcaggctcaagcgatttgcctgccttgaactctcaagtactgagattacaggtgtgagcccccgcacctggcctgtttgctatttcttaaacaactctaattttataagaaatttgaatatctcagttttatagtcttaaagtgactatacaatttttgccatctgttggaaacaactctcgacactcttcagttctggttaactctaaaatttctgctgaaacccacttcggttaaacattcctactctactcgatattttgcttcttcgcagcaagtggtcttcctaggcggccaggactcatttaaggaaatatgtccccatgctttttattttattttgaaggaaaaattcaagttagttaaagacctgaatgtataatactggatgaaaaataaaaataaataataagccttaacttgaacagttgagctgttcataaaactgccctcccatcactgaactagactgcagctccatgtaaatggcagtttccttctcccaattaaatgtgcattcctgggctgggcacagggtacaaaataaagagatagttaaaaaataaaaagcccaaagttgctctggaaaataagcatatgatttgtgaagcagtatgtacatcagtgtggctggatcatcaccaagtagtgtggctataaatggcaatcaggggcaaagtgctcacacctgtgatcccagcactttgcgaggatgaggcaggagtatcacttgagctcaggagttcaagaccagcctcggtaacatagtgagaccctatctctacaaaaaataaaaaaattagcctggcgtagtggtgtgtgcctgtggtcccagctactcaggaggttgaggtgggaggattgcttgagcccgggcggtggagggtacagtgagccaagatcgctccctggcattccagcctgggcgactaagtgagaccctgtctcgaaaataaaataacataaactaaatttgcactttctgcctcaatatttattttgaaaattttcaaatctacagaaattgcaaaaatagtatgataaacccccgtttaacctgcatttagattcatgaagtttttaaactgccacattgcctttcgtgtgtgtgtgtgtgtattttctgaaccatttgaaagttgcatgatcataacccttcaccaaatccttacgtgtccacctcataagagatgctgtccttatctcttgatttgatatacaatgatcaagttcaagaaaattaacattgatatattacccatcatatcaatgataaaaatttcaccaactatccccatgtctttaataacaacctttgtcctaatccatgttctaatccagggtcatgcactgcatttagctgtcattctcttttaatctccctttcaactagaatgattcctaaggctttgccttcatgacactgacatttttgaggtactaacaactacgttttgtagaatttcaatttgggtttttgttttctcacagttagattcaggttatgccttatactcgtcctatcaggaggaccgcaatgtttgtttgttccatggataacgttaactgtgatcacttcattactgtggtaacaggcttctcgactgtatccttcaccctttgtaattaataagcaatctgtaagatgatattttcagactatatgagtcctccgttctccggcaaattttcaagcagggattttggcatccgtttgtaattcttgcctgcatcaatttttacagtgacagtcgcaaacagaaaggaaatttagacattctaaggctgattcttccctactataggattcttttttgagaaatccaaatgtaaaacacacctgtctccgtcacactaattcactttcaaatacttcattttttaaagctatctcatatgtgctttcttacaaccttccttccataaattaaaaatacataaagtaaatgagtagattcactttatgtattatgtgttaacaaagttaacacagaaacaccaattatatttttataaattatcaatgaacaatactgaaaattttttaaaatttacttaaaacagtctcaaaagccataatataattagggataaatattagtttcttagggccaccatagaaaagtaccacaaattgcgtgacttgaaaatacagcaatttattttctcacagttctggctaaaagtccaaaataaatgtgtcagcagggccatgacacttttcaaacttgtaggggatccttccttgcctcttccttgcttctgacagtatgctgataaccttagacgttccttgggttgtaaatacatcactccagtcctccagcctcacgtggtactctgtgtctttacatcatcttccttctgtgcgtgtctgtctctgtgtccaaatttctcctttttataaggaaaccagtcataatggattagggcccattctaatgaccttattttaacttcattactgaaaaaaattgaaggtgacctacacaaacagagaaatatactattttcatggatacaaggactctgttgctgtttggatgtcaattctccccaaattgttctattaagttcaatgcaaccccaatcaaactcctaacaggctgttagtagaaactggtaagttgattgaaaaatttaaataggctgggtgtggcggttcaggcctgtaattccagcacttcaggaggctgagacgggaggactgcttgaggtgagctgttcaagaccagcctgggcagcatagcaaaaccccgtctctacatacaaagaataaatatacggaggacgggcacgatggctcacgcctgtaatcccagcactttggaaggtcgaggcaggagtatcatctgaggtcaagagttcgagaccagcctggccaatgtggtgaaactcccgtctctattaaaaatacaaaaattagccaggcatggtggtacatgcctgtaatcgcagctactcaggaggctgaggaaggagaactgcttgaacctgggaggcagaggatgtagtgagctgagatcacgccactgcactccagcctaggcaacagagcaagactctgtctcaaaaagaaaaaaaaagatttactctaaagtcacagtaatcaagacagtgtgacactaatattagaatcaacggatcaatgaaatagaatagacccacattattttttttaaaaagtcttttcaacaaaaggtacagaaataactgatacccatatgggaaaaagttaacctcaaccccctaacttatacaatattcaaaattaatttgaaatggatcaaagacctaaacataaaagttaaaactggccagacacagtggctcacacctgtaatcctcgcactttgggaggccaaggcaggcggatcacgaggtcaggacttcaagaccagcctggccaacatggtgaagccccatctctacaaaaaatacaaaaattagccaggcatggtggtgcgtgcctgtagtcccagctactcaggaggctgagggaggagaatcgcttgaacctgggaggtggaggttgcagtgagccatcacgccactgcactccagcctgggcgacacaacgaaattcagtctccaaaaaaaaaaggtaaaactataaatcttttagaaaaaaaaatagcaatatcttagcctgaaggtagctaaaggtttcttagaccataaaaagcaataaactataaaaggaaaaatttatgagacttcatgaaaattaagaatttcagctcgtcaaaacaattaagaatatctggcaaagtaccagtattcaaaatacataaataatgtctacaactgaatataaacaatttaggggaaaaagaattaaacagacactttacaatggaagagggcaaaactgtcaataagcacatgaaaaagaacactatcattagttacctggaaattgaaattaaaacaagatactactatcaatacaaatcaactggaatggttaaatctaaaaagacagataacatcaaaagttggtaagatgtacggcaaccagaacctgtatgctgttggtgggattacaaaatgacacaaccactttcgaaaaagatctggtagtttcttctttctttttttgagatggagtctcactctgtcaccgaggctagagtgcagtggcgcgatctaggctcactgcaacctctgcctcctgggttcaagcaattctctgcctcagcctcccgagtggctggtattacaggtgcccgccaccacacccggctaatttttgtatttttagtagatggggtttcagcatcttggccaggctggtcttgaactcctgaccttgtgatccacccgcctcggcctcccaaagtgcgtgagccaccatgcctggcaggtagtttcttataaaaatatgtacctattctacgttgcgtaattccagctcctaagtatttaaccaaaaaaaccctgaaaacataaggccacacatacacacacagagacacaaaaacttgcacaagaaccttctcagcaactttattcataatatccaaaactgcaagcaactgaagcactgtatcagtggagaatggccaatcatatacagcatagtcaatggtggaataatacttaaaaaacgaatatctacacaagaataaatcttgaggccaggcgcggtggctcatgcctgtaatcccagcactttgggaggccgaggcgggtggatcacctgaggtcaggagttcgacaccaggctgggcaacatggtgaaaccccatctctactaaaaatacaaaaattagccaggcatggtggtgcgtgcctgtaatcccagctacttaggaggctgaggcaggagaatcacttgaacccaggagacggaggttgcagtgagccgagatcctgtcactgcattccagactgggtgacagaacaagactgtctcaaaaaaaaaaaaagaataaatcttgaaccttatgctgaataaccccccaaaagatatgcttaagtcctaactcccagtaactaagaatgtggtcttaactggaaacaggttgttacagatataatggagttcatacaaagagtacagagcctttaatccaatataactagtgtcctggtaaaaaaaaaagagagagacacagaggagacggccatgtaaagacagacacaccgggaaactctacgtgccaatggaggcagagactggagtgactcagctgcaaaccaggaacaccatggattccagccacaccagaagctaaggagaagggcacggaacagattctctcccagagccttcaatgtacatgtccctgctccctgctagcatcttgggtttggagttctactcttcagaactgagggagaataaatttctgctaagttcgtggtactttgttacagtagccctaggaaataaaaagaattccatttatatgaagttccagaacagaaaaaactcatctatggtggataaaaactaaaacagcccggacgcggtggctcacgcttgtaatcccagcacttttggaggccaagacaggtggatcacgaggtcaagagattgagaccatcctgaccaacacagcaaaaccccatctctactaacaatacaaaaattagttgggtgtggtgtcgcatgcctgtaatcccagctactcaggaggctgaggcaggagaatgcccacaactcaaaaaaacaacctgattaaatgacaggcaaagttgtggctttttctgggttttgggagaaaaacagaaacaaaaagaatgaatgagcacaggatttgaatagatatttcatatttttccgaagatgatatacaaatggccaataaatgcatgcaaagatgctcgccatccttagtcattggggacatgcaaataaaaaccacaatgggataccacctcatactcaccaggatggctactatcaaaacccagaaaatagcaagtgttggcgagggtgcagagaaactggacacccacgcactgttggtgggaatgtaaaacggtacagtcactgtggaaaacagtatggcggtttccaaaaccaatcacacatagaattaccataggatctagaaattccacttccaggtatacacccaaaagaatagaaaacaggcccctgaacagacatttgtacacccaagttcacaccagcattatttctaatagccgagaagtggaagcaagccaagtgtccactgacagaggaacagatttcttttaatgtagcatatacatacactggaacattattcagcctggaaaagaagggaatgctgtcacatgcagtatggatgaacctggaaaacattacgctaggtaaaacaggccagacacaaaaggacaaaacctatgaaaattccacttacaggaggtacctagaagcagtcgggttcacagaaatggaaaggagaacggtggttgccaggggatagtaggagggaggaacggtgagcctcaagggtgtggaaattcagtttgggaggattaaaaagttctggagatggacggtggtgacggatgcacagcagtgtgaacggaggcgatgccactgaaccatacaattacaaacggttaaaattttcctcccttctttctagtcaaaaacatttttaagtggttaaaatggtaatcttgctatattttaccacaattttttttttttgaaacggagtctcgctctgtctcccaggctggagtgcggtggcgtgatctcggctcactgcaagctccgcctcccgggttcacgccattctccggcctcagcctcccgagtagctgggactacaggcgcgtgccaacatgcccggctaattttttgtatttttagtagagagggggtttcaccgtgttagccaggatggtctcgatctcctgacctcgtgatccgcccgcctcggcctcccaaagtgctgggattacaggcgtgagccgccgcgcccggccccgcaattttttgacacacagagttaagataccagttcacatgtactagcatggcacggaaaataacaagtgttggtgaggaagtgaagaaactggaaacttcgtactctgctaatggaaatgtaaaatggtacagccactgtagaaatcaatgtggcagttcctcaaaaagctaaacacagaattaccataggatccagcaattccactcgtagatatatagacaaaagaactgaacacaggtattcaaacacatactggtacataaatgttcgtatcgccagtattcaaataacgaaaaggtgaaaaaaaccaatgtccagccaatggataaacaaaatgtaacaagtatatccgtaaaacaaattattattcagcccgaaaaatgaagtactgatccatgccacactgtacatgaacctcagaaacacgctaagtgaaataagctagacacacaagatcctatattgcatgagtcccttctatgaaatacctagaatggccagattcatagagacagaaagtggaatagaaggtgccgaggctggggggaaaggtgaaatggggagtcagtgcctcacggttagagtttatctggggtgatgaaaagttctggaaacagtggtgatggttacattgtgaatgtaattaatgctattgaattgtacttaaaaatggttaaaatgtcagtttgttatatacattttggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagcgctagcaacgtcacaaccgcccgccaaaatcgcacttcccacccagaaaactgcccaagggcgaacgttcccggggcgggacttccggggtctgcgcgccgcccgccctccctcccagccggagacggtcccgccctggcgtcgcagccccgcctagtgcagcctgggtggagcctgacctttccctgagatttctgcgaggcctcagacacccctggtttcttggtttctgggtagaaaaagggaaacctcaaaacaaaatcaacagccaaacaaggccgggtgcggtggctcacgcctgtaatcccagcacttcgggaggccgaggcgggcggatcacctgaggtcaggagttcaagaccagcctggccaacatggtgaaacccccgtccttactaaaaatacaaaaattagctgggcattgtgacaagctcctgcaattccagctactcaggaggctgagacaggagaatcgctaaacctgggaggcagaggctgcagtgagccgagattgtgccactgcactccagcctgggggacagagcaaaattccacctcaaaaaatacaaataaataaatagataaaagaattggggtctcactgttttatccaggctggactacaactccagggttccagggattctttcgcctcagcctctggagtagctgggtctagagcttgcaactccatagccagctccggacctgcattttttgagggaatcaatcagtgtgaaggaagagaaaagaaaatcactgtgcgtgaaagcagcctttaagttgttttgaggctgctgagagcattcaggctgggtaggggatggtttccaggttgagaacaacgaggagacatcggtcgttggtagaagtctttgggaactttcatttcaatgtgggttcagaaacctgttattgtctgtgatagctcacacctgtagtcccagcactttggaaggccaaggcgggaagatcagtggagcccaggagttcaggtccagcctgggcaacatagtgagaccctgtctctacaaaaaataaaaaaattaactcggtgtgctggctcacacttatactctcagctactctggtggctgaggtgggaggatcacttgagcccaggaggtcaaggctgcagtgaacagtgatcgtaccactgcaccccagcctgggtgacagggcaagaccctgtctcaaaaaaaagaaaaaaaaaagaaacctgggactgtcatctggttgtctacagtaacagtaccttagcttggaatttcaggcttgttttttgttcgtttgtttgtttttttgagatggctcctcattctgttgcccaggttggagtgcagtggtttgatctcagcttactgcaacctccacctcctgggttcaagcgattctcatgcctcagcctcccgagtagctgcaattacaggcgcgtgccttgtaataccacgtgcattgtaataccacgcctggcaaatttttgtattcttagtagagatggggtttcaccatgttggccatgctggtctcgaactcctgacctcaggtgatccaccggccttggccttccaaagtgctgggattacaggcgtgagccactgcacctggccttcaggcttcctaatatgtccacaacctgcttttcccatcgaatctcccattattcttttaaacatgcaactatgatttattctctgtcatccaaacgttttgctttcatgacattgctttctcggttcatcctaaatgggttgctttgtggctgtgcctacttcaaacaccaatttaatgcagttgggccaggcacggtggctcatgcctgtaatcccagcactttgggaggccaaggagggcggatcacaaggtcaggagttcgagaccagcctgaccaacatgttgaaactcagtctctactaaaaatacaaaaattagctgggcatggtggcaggtgcctgtaatcccagctagtcgggaggctgaggcagaagaattgcttgaacccgggaggcagaggttgcagtgaggccagattgcaccactgcactccagcctgggttgacagagcaagactccgtctcgaaaaaaaaaaaaattaattcacttcttccagagtgcacttttatgtgcaatttaatgcactccccaccaccagtaatgccccttttctaaactcacccagtcatatattgcccagtgatactgatttttattgcagttttactattgaactcctgtattttgatttctatcttcaggtgcttatgtcttgtgtaatggatatatttcatgtacttcctcagatttccttcactttgtttgctttctgtacccataatcacttgctctttttggggctcaccagttgcatttccggaatctctggcttctcctgccacttctgaacaatgcaggagctgacttctcagaggctgctagggcctcggtaatgcatgctgggagggtgggggggtcactccccatggagtaactttcaccaattgaaaccagtggactgaccgagcacaatacttaaattcccttttcttcttccttccaaggatggtttctccagtgtgtctggagacaggcaagactgagggagtgtgcctgctgaaaaagctgctgtgtctcttgtggctcattttcaaggaggggacagcaaggtaacacatcaccatgtattacttcacatccttctctacctaacttccttccagctttcttcactctggctgtcctgaatttgtacctcccaaataaagcatcggcacttaatctttacctcgagggcaggatccacatttttaatgtttctgttatccacagtacctagtacatggcatttggtattcgataaatattataaataaatggtcaagatgtaagaatctcctttctggtataaataactatggtacttcattagagaacaaatacacattaagatacaatttataggatctcatgatgtatattttaggtgtttttgttttaatttatgaaaatagagatgaggtctcactattgttacagctcttactcccgaatttgatgagttctgagttgttgtcccatgactgagaagaatgaggtacacggacactggagagtgagtaaggcaaagtagaatttattgagtgacagaacggctcttggcagtgagaggggacccgaaggtgggttgctggccacgagcctgagtctatgggtttttgtgggctagaaatgggcaagtgcatgctgattggtctgtggctatgcttgacaaagcaccattcagaaataggcacgatagtgtagaggaccaatcgcggaagggtaggtatgtataaaataggtgaagggtaaggaccaatcaggagagagggtgccagacgagaatgggagctctcagtctggctcatggatttatccagaactcatagcttggttttcaggctttagactgtccttggcttgaaggttgagtttcaccagggacccctccctgtctgcctaggaatttacctgcctcctattgctatcactgtgttgcccaggctggtctgaaacccctgagctcaagtgatcctcctaccttggcctcctaaggtgcttggattataggcatgagccaccatgtccggccttgtttattttttaaataggtaatacattcacatggttcaaaattgaaaatgtaaaaaatggattaacagtgaaaagacttcctcttgtctttgacccctagcctcttagctttctttcctgacaactaatgttatcactgtcttgtgtatctctgcagaagaagtttatggatatgtaaactaatatgtgttatatatatatttatatatatatatttgtcaccttttttccacttagcaatgtatattggaaataaacatttgaaaacaacaatacatttggtgatcacttcatatcattacacaaagagcttcttcattcttttatatggctgcaaagaaagtatctattgtatcaatttgtcataatttatttaacatcctctcactctttgctataaaaataagactataataaattgtgcatactttttgctgtttccaagataaattactgtaggtggaatcactgggtcatagggtaacaggttagtttttgacagatggtatcaactcttcgagggatgacttttgcttttcaggggtcctaactgctttccccttctcaattacctgcacagccctcagcaaactgtcctgcagagcctggttctttaccatgttagtaattaggaacgtgacatccctgatgtacatctgcctcactttagcagtatagtgttctgccttgttaccacgtgcaataaagaaggtacaaagtgctgtgatgtctccttcttgcagcccacactcctccagtatggactcccatacaactctaacgcgcttgttcttaacttttcttctgagtacagaggctaaggttggaagacctctcaccaggtctggcagcttctcaagcacacgagtatgcaagcagataagtacttcaatgacgtagctgtataaaatattcaattccattgaagtgagcctacaaaaaatatggagagcttcttaagcggtcaaaaatattttatatagaaacagaaaatgaattcttttaggataactcaatatgaacccactaggagaaccagctgttgtaatttagaaaatatttactttagaatttaaattcaaattcaaatacttacattttatttttttttaagagacagggtctcactttgttgcccaggctgttctcaaactcctgagctcaagtgatcctgtcgcctcggcttcccagagtgctgggattaaaggcgtgagccatcatgcccagccagtactcactttagaattaatgcagataggctgggcgtggtgctcacgcctgtaatcccagcactgtgggaggacgaggtggttggatcacctgaggtcaggagtttgagaccagcctggccaacatggtgaaaccccgtctctactaaaaatacaaaaattagctgggcatggtggcgggcgcctgtaatcccagctactcgggaggctgaggcaggagaatggcgtgaacccaggaagtggagcttgcagggagccaagattgccccactgcactccagcctgggtgacagagtgagactccatctcaaaaaaaaaaaaaaaaagaaaaaaaaattaatgcaaataaggctttggcaagcaagagactttgtgatgagatgtgtactatagtgcctggcatataaagagatgctcaaattaatcttttttttttctttgagacggagtctcgctttgtcacccaggctggagtgcagtggtgagatctcggctcactgcaagctccgcctcccgggttcacgccattctcctgcctcagcctcccgagtagttgggactacaggtgcctgccaccacacccggctaatttttttttttttttttttttgtatttttagtagaggcagggtttcactgtgtcagccagggtggtctcgatctcctgacctcgtgatccgcccgcctcggcctcccaaagtgctgggattacaggtgtgagccactgtgcccggccaaattaatctttttttaaaaaaataaatgaacctaagaaaatgtaattgctttacaatccattgtgggaaacatactaagaaattcaattttgcaatgaccagtggaagctctcacaaagccacagaatcccactgatttctcaattgatactcactggagtgcccgaactgctgtccacatctcatcttgggctgcttggcttgccaaagccttactatgatgttcgaatttctgcatcaggttatccttggtgaagtctagttctttgaactgtgtttctaacgcttggagtttgtggtctactctgtaggataacagaatcaagggttagtttaggttacaggacaaaactaaggttttgatttaagctgaggctctaatacattatttacaaccattaccaaatttggataacttttttttttttacttttactttaaactatgaagggaaaatgggtagctatttgaatttgaaagtttcaacaaatggctccatttgccattccctctagccatcatccttgtcctttcattccatatattgcaaacttttgaattgtctaattatttgaattgcctgtcgtgtcttgtttttgtattataccttatactttatgtatttatttattttctaatacagagtctcactctgtcacccaaaccggagtgcagtggcacaatcactacctcccaggctcaagtgatcttcccacctcagcctcccgagtagctaggactacagttgtgtgccaccatacctggctaatttttaaaaaatattttttgtagagaccaggtattgctatgtttggctggtcttcaacacctgggctccagtgatccacctgtcttagcctcccaaagtactgggattacagccatgagccaccatgcccgggctataccttacgatttagagaatattttatgtaagcattactttggtgttcacagcaaccataaaaagtaaagcagtcatttttactattttactattaaagaaattgagtctcaagaggattgagacctaatgtcataaagttagctagtgctgagaccagtatataatctggatctcctcggcaggaaagtcaagggccttcaccctttgctcctatcttccgccagtcccctcacccatcctagtcaccaattacatgagacatctagttgctgcttgaatacattatgtggttccaagcttacatatggcttataccctattttctacccgattctaattgtccaactcttatcctttcttccagaatcagctcaaatccactgcctttttgaatccccatctacctggtgatctccttgcccccctgcgtctcgcttacaagcactgcctctgtggacccatctcccgcctcctgctttactattagggttagcctttcatgaactaaactacgttcttggagggaaggaatcagagactatttcttagatacctttatgtctgtcccccaatacccagcaaaggtcttgcacagtaataaaagtttccctgtatgattgacatctttgatgagaatgaaatgctgagttctgtaacccaaaatggggatttgagtagctccgaacagccatgatcatcagaggctgctgtggcaccagcattatgtctaattaaccacaaagactggagcaacacaattcacttgcctgagccacctagattgtccttatgagggaaacttgcctgggccacctagattgtcattatgagggaaatttgcctgggccacctagattgtctttatgagggaaacttgcctgagccacctagattgtccttatgagggaaacctgcctgggccacctagattgtctttatgagggaaacttgcctgagccacctagattgtccttatgagggaaacctgcctgggccacctagattgtccttatgagggaaacttgcctgggccacctagattgtctttatgagggaaacttgcctgcgccaagtagattgttgttatgagggaaacctgcctgggccacctagattgtccttatgagggaaacctgcctgggccacctagattgtccttatgagggaaacctgcctgagccacctagattctcattatgagggaaacctgcctgggccacctagattgtccttatgagggaaacctgcctgggccacctagattgtccttatgagggaaacctgcctgggccacctagattgtccttatgagggaaacctgcctgggccacctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtcgttatgagggaaacctgcctgggccgcctagattgttgttatgagggaaacctgcctgggctgcctagattgtctttatgagggaaacttgcctgcgccaagtagattgttgttatgagggaaacctgcctgggccacctagattgtccttatgagggaaacttgcctgagccacctagattgttgttatgagggaaacctgcctcggccacctacattgtccttatgagggaaacttgcctgggctgcctagattgtccttatgagggaaacctgcctgggccacctagattgtcgttatgagggaaacctgcctgagccacctagattgtggttatgagggaaacttgcctgagccatgtagattgtggttatgagggaaacttgcctgggccgcctagattgtggttatgagagaaacttgcctgggccgcctagattgtcgttatgagggaaacttgcctgggccaagtagattgttgttatgagggaaacatgcctgggccacctagattgtcgttatgagggaagtgatgcgtcaacacacatgctacttctctgagcttccgtatctccagtgacctgaatacctttgtgactgcccagcattctatgcttgatcatcttttattcttggtcctaaatttctccctaggctaattcaccttcaggtactacatctctcctaagctttaaacctgtatttcctttctttttttttttttttttttttgagatggagtcttgctctgtcgccaggctggagtacagtggcacgatcctggctcactgcaacctctgtctcccaggttcaagtgattctcctgcctcagtctcccgagtagctgggattacaggcgccaccacatccggctaatttttgtatttttagtagagatggggtttcaccatgttggccaggctggtctcgaactcctgacctcaggcgatccgcccacctcggcctcccaaagttctgggattacaggcgtgagccaccgcacccggcctagagatgtattttcaatatgttttgtgcatctccacaaagatggagatgtcaaactcaactctcctaagcttaacctactaatacctcccccatcttcagaaattactatgaagaaatgttgtcactgctttacacatagataagactcagtataaaatgttcattttgtaggaatagaagcctgtgtgacctgatatgcctgtaatttctgtctacaagtcaaaaccatgtgatttgagctaggtgcagtggctcacaactgtaatcacagcagtttgggaggccaaggtgggtggatcacttgagtccaggagtttgagaccagcttgggcaacatagtgagacctcatctctacaaaaaataaaaaattagcctagtgtggtggtgtgcacacttgtggtcccagctactggggaagctgaggtatgagaattgcttcagcccaggagttcaaagctgcagtgagctgtgatcatgccactgcactcagcttgagcaacacagcaagaccctgtgtcaaaaaaaaaaaaagaaagttggccgggtgcagtggctcacgcctgtaatcccagccatttgggaggccaaggcaggtggatcatgaggtcaagagatcgagaccatcctggccaacatggtaaaaccccttctttactaaaaatacaaaaattagccgggtgtggtgatgcacacctgtagtcccagttactcaggaggctgaggcaggagaatcacttgaacctgggaggcggaggttgcagtgagctgaaatcgcgccactgcactccagcctggtgacagagtgagactctgtctcaaaaaaaaaaaaaaaaaaaaagccatttggcatactattttgtgttaacttttagacctttaagactatattgcttataggtcatctgtagtttgaaacttagggaagaagtctagcttgtcaatcagtataaaaatttacagttgcagcagttctttggaatcctctcaccaaaggacagtccgaggccgttccagataaatctcaaccaacatgcaaatctcagcgcaggctgttttgttttgttttagtacagttccctagtttcgttaatgacctcaccatccaatcaattgcttgaactagaaatctcagaataattctcaacttttttcttcccctgatttatgtctctctaacccattcctgcctctccatctccatcaaatgagtttctcatcatctttcactaggacccaagattaccgtagcctaactggacccccgttttccatttcccatccatcctccagacacattcttctaaaacacaattccgattctgtgactcaactgattacaaatggtttatgtcatcctggcttgcccagtgatatactcagaggcaaactggatctcctcagcaggaaagtcaagggccttcaccctttgctcctgtcttccaccagtcccctcacccatcctagttaccaattacacgagacatctagttgctgcttgaatacattatgtggttccaagcttacatatggcttatatgcactgtttcctcagcctagaatgccttcccatatttttctccctcataagctcctacttgcactttaagatccagcttaaatgaccctatatgaagagttcctttttctagtgtcaaaggcaaaattggttgatcctcccttcatgttcgcatagacctttaggaacatcaccattgtaaggtcagtcacattaaattgtaaatgtttttcaaacttttctctttcctacaggctgtgagctccttgagggcagaaaccacattttacttatttttgtaaatctaggatttagcatatgcatacattcaatggagttacagcacctgggagcagacttttctttattgttaatttacataggtttgggcctggaagacttaaaccactgtaatagagacggaattctttttttggacggagtcttgctctgttgccaggctggagtgcagtggcacgatctcggctcactgcaacctccacctcccgggttcaagtgattctcctgcctcagcctcccaagtagctgggactacaggcgcccgccaccatgcctgggtaatttttgtatttttagtagaggcagggtttcaccatgttcgccaggctggtctcaatctcttgaccctgtgatccgcccacctcggcctcccagtgtgctgggattacaggtgtgagccaccgcaccggccacagagacagaattctaatgagcatgtctgcagttctttatttctattcttcattcttctcttacccatcttcccagaatagcagacccatgcttgctccctccctatagccctcagcaaccttttcattgcctccttcaaggatatcagggttgtggtttcattgttcatcttctgaaggcaaaaggaaagaaaacaaaaacaaagcaaaacaaaaaaagcaataaatgtttgaatccagaattttctgcggtcttcctctcagcaacaggcagcagtagcaggagcgctcagtctacattctgcctgaaaggtcactcagtacaagaagcttttaatagcctgcagatccaaatatagtttcaaagaacttatctcgtggacacaggtgtcctggaatgcactataacatttgcctttgaaaactgaaccatagtacattaacatacagcaacaaccatgtataattaatgactgtgtacattatggtaaatgtatatacagatacattaacgtaacgtataggattaagtttgatggaaatattactgtcatattttaactgcttcattattcaattacaacctaaattaggtttgaagagtgccccagatcttttatgatgatgatatcaaagcaaaaaatctaactatcattagaaactactaaatacttgttatggctgggtatggtggctcactcctgtaatcccagcacttggggaagccaaggtgggaggattgcttgagcccaggaattcaagaccagcctgggccacagagcgagactgtctccacaaaaaatacaaaaattagccaggagtggtggtgcatgcctgtagtcccagctactcaagaggctgaagtgggaggactgcttgagcccaggagttcgaagctgcagtgagctatgatcatgccactgcactccagcccgggcaagaggataggatatatatatatatatatatatatatatatatatatatatataattatatataaaattatacatataattatatataatatataatttatatcgtatataaaatatatatataattttatataattatatatatattagattaggaattgaatataaatgtggaaataaaataggactgctgttttcatgagatttaaaatctagttgggaagaaagaatatatccttaaatagaaaatgtatatgggatgtgtgctaagtagatagagaccataaaaataatagaaggtgagagactaagtcactgaaatcttgggtccttggggagatattcaccctgaaggtggtacttggcttggccttaaaggtcaaggtctttgattatcagagaagagtgttaagggtgttacgaactggagaaattgtgtgagcaaaatcacagaggtggcaaagtaaatgatgtgttcaggaaacaatgagtaggtatgttttgagcaaaagattcatataagaaaaagaaaataaccacaccatttaaactggtaagagccatgtcacgtatttgttctttcactgaatactttattcacttattcaatatttactgagcatcatagatattaattgaatgtataaaacctacgaatggatgagcagcactattccaggcactggtaatatagtgataagtaaggcgaaatccttgtcctcaaggaacatactagcagggagacagcacataaggcttataagagaggggatgcttctagctagcttggtaaggagtttggacagatgtgagctgttggttctagaagattaatctaggctcaggtgcagtggctctcacctgtaatcccaacattttgggaggctgaggtgggtagatcacttgaggtcaggaattcgagaccagcttggccaacatggcaaaaacccatctctactaaaaatacaaaaattagctgggcatggtggcacacacctgtagtcccagctacttgggagtctgagataggagaatcgctcaaacccgggaggtggaggttgcagtgagcagaaatagcaattgcgccactgcactccagcctgggtgacacagcgagactccatcgcaaaaaaaaaaaaaaaaaaaaaaaaaaaaagattaatctagcagtgatattgtagtataatatgaaatatatttggtcttcgtccccatttcagccacaaagctcctaaaacccttggaatttcctgagtgataggagtgtctttttttattcataatgagccccttttgatcacatgtgagtttatgctaatgaggtgatttagggtggtgcaactagaatagcctccagatggggctggtcactagaaagaccaggtgattctaagttggaactttcagcccccacccaccaacctctaggaaatgaaatgagtgagctggagattaagttccataaaaattcttggacaatgaggtttgatgagcttctgggttgccaaatataaggaagcgctggtgggatggtgctggggagagggtgtggaagctctacagcaccctccaccatatcttcctctatgcatctctaacagcacccccccatacctttccctatacatatctaacagcacccccctgtgccttcccctatgcatcactaaaactgcctgttcatctgaattctatttattttattttcttgagatggactctcactctgttgcccaggctggagtgcagtggcatgatctgggctcactgcaacctctgcctcccaggttcaagcaggtctcctgcctcagctcccctagtagctgggattccaggtgtgtgccaccactattacaggagttattaaaaaattattttagtcagctagaaagggtaaaagagtcctcagtaatgctttttattttaataaaaaagcagcccccgcaaacatttcttttctaacagaaagtggctggaaaaaccagacctgcaagcattgatttgcaagtcacaggcttacatatgtaaatgctggtggctaagagccaggttcacccaatatggcagttcctgctgctttttctttgttgccacatgtgcagatatcatggcagccagccaggtagaagtaacatgtacaggcatcatggcaaccagccaggtagctgcatttgcataataaaaggctagggtgggagggccagtttttttgtgggctacgtgaatgccacacctggtcaaaccaatcccttgggctctatgcaaatcagatgccacctcctcaagcctcctgacataaccaactgctttctgctaaagggggttattccatttggagccctcctcccattgtacaggggagctgttctcttccttcttgcctactaaactttccactccttaatccactctacgtgtgtctatgttgctaattttctcggcatgtgacaaaggaccctggatgtttccccagacaatggagccatatcacgatgctcagctagtttttgtatttttagtagagacggggtttcgccatgttggccaggctggtctctaactcctgacctcaagtgatccacctgcctcagcctcccaaagtgctggagacaaaggaccctggcacaagacaaaggaccctgggtgtttccctagacaacgtagccatgtcatttttgggggctcatccggaatcccaaggtacaacattcaatggagcagtgagtagaggagcggactcaaaatctgtcctttcattccaaggctcttggtctccattttaaaatctaatcaaatcaataacaagcatccatcagccagttaaagacacggttagtgtggctgccattcttagagacttggatgtcaggcttactggggagaacatggagacccccccaatacccatgggtcactgggcacgttggccatgcttcaaatcagcttcctttcaacaaggaaacctaaccatcccgtgaggccaggaaaagttcttaagcaattgagaatttctggccagtgcacacccttgtgttattcaaatgcttctggactggactcagcctccaatagcctgcccaggtgttggtaaagggtccccagctagcctgttgcaaaatttcccttctttttctatctgcgatcactatgtctcttattttctctgtgtgtcaaatgtgagggaatttttgcagcccagggaagtaatcctgttggggaagatcaggaaatgctgtagtaaccatggatgtagttcaggatcttgtgatcttttaggaacagagggcctcccctttcccacacagtgaggtcactcgctactagtcctcgtgcgagcacgtggtatatttaagccaacagcgccacctcgtggaaatagaaatcccctctgtaagacacgttggtccactgtagcttcccaatttttccattttgcagctttctttatgctgcttctgtgaataggaaaattctgccccaacaattaggagtaaaatgtcctctgcagccaaattttagtcctgatactgtcccatcggcaggaaaatcgccattaggtccttaagtccctttaaggcacctattctgtctccaattaaaacagtacttaattagtaaggggattttaagtctggaagttaacctgaaccattttctaagggtaaatgccctagtgcgggccataatagtagccaatccagcacattccctccgttaaagaagccttgccttttacatagtttttcccaagatccattttccagggaggcacacagatcacacaagtctaggaaataaaaggggaaccacatgcagagaactaggatagcatgggtaggcatgactaatcccatcttctagtttctctggttccatggcttggagagtcacacctacaaccacgggcggcacatttaacaaggtgccaggacccaggaaccaaggagggaaaacagtcgggggggacgctcccactgtcttcttctccaccctgggtcacacaccaaaaggaaggagactaaatggatggctttttctcacttctctttctagatgggaaacagaccatctacgacctgcactcctctcaagtgcattctaaaacgctgggacttcttcaaccttgagactttgaagaaaaagcacctcatgttatattgcacaagggcatggccttcttaccatcctggggacagacaaacccgctggagggagccttgcttttaatattatccaaaaattcgatcttttctgcagacagaagggcaaatggtctgaggtcccctatgtacaggctttctctgccctgtgagacaacccagatctttacaagttttgtacaatggactcagttcttttagcagccatggcaggcaagcccataggtaataattccccagagctaaagcagattccagaggagcaatctgagacagctattgaatgtcccaacccttctagtccccctcatccagaaccccctccaatcatgccatcagctcctccagctccaccatcttcaatatcacccactttgcccacttcgctcttacctctgcaggaaatgcctgatggaaatggtgctatgaagcttcatgttcccttctcattacaggatcttaagcaaataaagggagacaagccgattttctgacgaccccgatagatatatagaaactttccaaaatttaactcaggtgtttgatctcacgtgttgctcctaagtcagactctcaccgctgctgaaaagcaggcagttcttcaggcagcagaaaaatatggagatgtgtgggtgaaggattacctaggtgctgagacaagagactgaaggcacaaactgtttcagtataataaagaaaatagttagaataagaatagttataatacaaattagatatagagatgatcatggatattatcaataattagtataaacattgttaatcattagctcttaatattgctctttgttgtattactaatatagccaaggaataactggcaggtatagggtcaggtgctgaagggacattgtgagaagtgacctagaaagcacgaggtgagccctcttgtcaacgcctgcataagggccacttgaggggtcctgggtcaagcggtaatgccagtgcctgggaaggcacccattacttagcagactgcaaaaaggagtctctctttccttggaggagtcagggaacactctgctccaccagcttcttgtgggaggctggatattatccaggcctgcctgcagtcatacagaggcctaaacccctcactgtggtgctgtgcttcaatagtcatgctccttgtccactttcatgttcctcccgtactccgggttcctctttgaagtttgtagcagatagtggtagaagaaagagtgaaagtcttaaaatctttgatctgtcttataagtgcacagatgaaaacactgacgtttgctgccttctctctctgcttcggctacctaaaagggaagggccccctgtcccatgatcacgtgacttgcttgaccttatcaatcacttggacgactcaccctccttaccctgctcccttgtcttgtatgcaataaatatcagcatgcccaatcatttgaggccactacgggtctttgcgtcttggcggtagtggtcccccgggcccagctgttttctctttatctctttgtcttgtgtctttatttcttactatctttcgtctccgtacatggggagaatacctgctaagccctgtggggttggaccctacagagataagcaacatgtctcctatagcagaccaaagagagaaaaaggaaatagggaaggtgaactaaaaatggaaactccattcccactaggaagagaagcagttctggcagacaaccctcatgggaaccacaatagctccgtcgatgaatggaaaacgaagcacttttaatgtgcatattagaggcctaaaaaaaccagagccaaacctcttaattactgtaaactatctacgatagaccaaaaaccagatgagaatcccacagcctttatggaaaggctgagagagacactaacaaaacacacctctttatcccctgatttagctgagggacagctcatcctgaaggacaagtttatcacacaggcatctccagatattagaaggaaactacagaagcaatctataggaccaaatagcacccaggaaaacctcctgaatatagccactttggtctttgataatagggatcaggaggaggcccaagaaaaagagaggaagcacaagagaaggacagaggctctagtggcagcattgcaagcttgcaaagtccaggatccccatggtgcatccactagctgttactgatgtggcaagtcagggcattttaagaaggaatgcccaaacagcaagaagaagccagctcaaccctgtccagtctgtgatggagaccactggagattgaactgctcccagagatggaggtcactaggttcagaaccagtctcactgatggtccagcaggactgatgagtcccagggctcaaccccctgctccagcagctcaaactgccattacagcacaggagctccaggtgtttctggaaattgaaggaaggtagatctccttctggatactggaggcaggctctctcttctctctaatccaggtctcccctcttcccatagcacaactgtaaggggtgtctcaggaaaaactctaatccgatatttttcttcacccctagctgcagatggaggggacctattatttacacatgcctttttactcatgcttgaaagtcccattcctttatcaggtagagatattctagctcgcaggggggccggcatccttacagccccaggacaaactctttgtctccccctggtggaagctaacattaatccagaagtgtgggctactccagaaagaagaggttgagctataatctctaggccagtccagattcatcttaaggatcccacttattttcctttctttctttctccttttttttctttctttttgagatggagtcttgctttctcacccaggctggactgcagtggggtgatctcagctccccacaacctccgcctccagagttcaagtgattctcctgcctcagcctcctgagtagctgggattataggcatgtgccaccacgcctggctaatttttgtatttttagtagagacggggtttcaccatgttggccaggccagtctggagcttctgacctcaggtgatccacctgtcttggcctcccgaagtactgggattacaggtgtgagccaccacgcctagtcaggatcccatttttttttcctaatcagagactatatcccctaaatccagaggctaggaaagggctagcagccattatcgataacctaaagatgcagggcctcctcaaaccctgtaatagcccctgcaacgccccaatattaggagtgcaaaacctcaataaggaatggagactagttcaggacctctgcctcattaatgaagctgtcgttccaatccatccaatggtacctaatccctttacactgttaactcaaatacctgagggaactaaatggtttacagtcctaggtttaaaggatgcctttttctgcataccgttacatcctgactctcaatacctgtttgccttcaaagatccctccagccagaccacccagttaacatggacgttgctgcctcagggattttgagataggcctcatctgtttggacaggcactgtcaaaagatgtctctgagtgttcccatcctcaaattagggtcttgcagtacgttgatgatactctgctctgtgccccaactaaggaagctcctcaggaaggcactgaagctcttcttaacttcttagctaacagaggatataaggattcaaaacccaaggcccagctttgcaaaacctcggtgaagtacctgggtttagtgctgtccaagggaactggagcattaggggaagaaatgattcagcctatttcttcctcccttctccctaaaacctcaagcaactaagaggatttggggacattacaggattttgtagactatggatacctgggtattgtgaaatagtccacctgttatataacctcataaaagaagctcagggagctaaaactcatctttattttattttatttttttagatggagtctagctctgtcaccaggctgtagtgcagtggtgcaacctccacctcccgggttcaagcaattctcctgcttcagcctccgagtagctgggattacaggcatgcgccaccacgcccagctaatttttgtatttttagtagagacggggtttcaccatgttggccaggatggtctcgatctcctgaccccgtgatctgcccacctcgacctcccaaaatgctgggattacaggcgtgagccaccacgcccggcctaaaactcatcttttaatctgggaacctgaagcttgaaaggcctttgaccagctaaaacgagccttgcttaaggcactagctctcagccttcctgtagggaagactttccatctgtacgtatcagaaaggaagggaatggccctgggagttttaacgtaagcttgacgagcagctcaacagccagtgggttacctaagtagggaacttgatttggtggctaaaggatggccagcatgcctttgagccattgcctcagtagccctactggtcccagaagcccccaaattaaccctgggaaatgatttaactgtttacaccccacataacatggcaggactactgtactctagggggagcctttggctaacaaacagtcgactccttaactatcaggccctgctgttagagggttccaacatccaattaaaaacttgtgcagtggctcacgcctgtaatcccagcactttagggggccgaggtgggtggatcatgaggtcaggagttcaagatcagcctggccaacatagtgaaaccccatctctactaaatacataaaaattagccaggcatggtggtggtgcatgcctgtagtcccagctactcgggaggctgaggcaggaaaatcacttgaacccaggaggtggaggttgcattgagctgagattgtgccactgcactccagcctggcgacagagtgagactccgtctcaaaaaaaacaaaaacaaaaccaaaaacaaaaaaattgttctcgcctaaatccagccactttcctccccaaggaaactagggaacctgaacatgactgtgaacaagtcctgatacagacctatgcagccagggaagatctcagggaaaccgctagagaacccacactggaccctcttcacagatgggagctcttttgtagaacaaggaatccataaggcaggatatgcagtagtcactctaaatgacgtcattgaaagtgtgtctctccgtccaagcactcaattagctgagctgatagctcttactcgagcactagaattaagcaaaggaaaggtagctaacatttgcactgactccaagtatgctttcttggttcttcatgctcatgctgccatctaagctttcttttaaatattttcagtatgtccaagagaaaacacctgcttccgtttatttagcggtaataacctatatggacttaaaaattttttttgtacagatgaggtttcaccatgttgcccaggctggtcttcagactcccaaagtgctgcgattacaggcgtgagccactgcacccggccaacattttcttttttagaaacagggtctcactctgttgcccaggctggagtgcagtggcatgatcacggcatactgcagcctcgacctcgtgggctcaagtgattctccttccttagcctcccaagtagctgggactacaggtatgcaccaccacgcccagctaatttttttttgttttaatttttatgtacagacaggcatcttactatgttgtcctggctggtctccaattcctgggctcaagtgattcacccgccttggcctcccaaagtgttgggattacagacatgagccaccacacctgggttattgttggatttactgaagaaaaggggcaggagaaaaaagttaaattacgacaaatctctaggtcaattagaagccatatctctgggatattttaaaaaatcagtcttaccgcttccgactctaaaagttaatgccattagtaacaacagcaggaaaaataaacctgataaaaaccagcccattcattttagcaaaaaagcagtttaactcaaaatacttagaccaaagtataacactacgtacccaaggtgccccacccaccagcaagaagagaagaaataattgctttaaaaatcaaaatatgcggccaggcgccgtggctcacccctgtagtctcagcactttgggaggccaaggcaggcagattacctgaggtcgggagttcaagactagcctggccaacatggtgaaaccctctttctactaaaaacacaaaaattagccgggcgtggtggcgcgtgcctgtagtcccagctacctcgggaggctaaggcaggagaatcgcctaaactcaggagacggagcttgcaatgagccgagatccgccactgcactccagcctgggcgacagagcaagactctgtctccaaaataataataataataataaatatgctcagcatttcttccagagatagcaacggtgctactcctgagagtgctcggaaggactaaagctggagtgaagataatgtctagggattggtatcccacaaaggctttcaaagcccaaggtaccacaagcacactaaactcgtctatgaattagaaaacaagatatcactgctgcttctttctgtcttttgaaatgtacaatattttgtaggctctgcccttcgatgtgaaagcaggactaagaaaaaacaactaagagggccaggctcggtggctcacgcctgtaatcccagcactttgggaggccgaggcaggcggatcatgaagtcaagaaatcaagaccatctggccaacatggtgaaaccctgtctctactaagaaaataccaaaattagccggacgtggtggcaggcgcctgtagtcccagctactcaggaggctgaagcaggagaatcatttgaacccagaaggcggaggttgcagtgagctgagatctcgccattgcattccagcctgggcaacagtgtgagactccgtctccaaaaaaaaaaaatagagacagagtcttgctatgttgcccaggctggtctccaactccaagctaagaaatgtgaaattatttgacacctaaatttttagaaccatttatcttaactgtgaaattaaacagatctaccttctcctgccttcagtcaaaccacctcacaaaaataagagaactgaaacaatccaaacatgatcttttttttttttttttttttttttttttttttgagatggagtcttgctctgtggcccaggctggagtgcagtggcacgatctcggctcactgcaacctctgcctcccaggttcaagcgattcccctgtctcaggctcctgagtagcttgggactacaggcacacgccaccacgcctggctaatttttgtatttttagtacagatggggtttcaccatgttggccaggctcgtctggaactcctgacctcaagtgatccacccaccttggcctcccaaagtgctgggattacaggagtgagtcactgcgcctggcccaaacatgatcatttttaaagtccttgaaagtattaaaactttgaaaagaaaagaaagaaggaaaaacaaaaacatggcagtgcaggaaagctttacaagaaagagggggtgaaaatcaatgggcttgtctttttttgtcaacaagcaagtgcaagaaggttcattttgtgacttgttcagttgtgttttgcatatctccattctgatcggaagggactttgaggtttttctgcaactcctgagcatctgcaggctccatcctcttatcctttatctgtctttgtctcagtcatctcaaagccaaacttctgtagaagtcaattgctgactcattgctgatctggacaaacagatgttgtcaaaagtgccatcttggctgggcagtggcttatgcctgtaatcccagcactttgggaggctgaagtaggcagatccctagagtacaggagttcgaaactagcctggccaatatggtgaaaccccgtctctactaaaaacacaaaaattagccaggcgcggtggctcccatctgtaaccccagcactttgggaggccaaggcgggcggatgtcctgaggtcgggagttcaagacctgccaggccagcatggtgaaaccccgtctctactaaaaatacaaaaattagccgggcgtggtagcacatgcctctaatctcagctactcgggaggctgaggcaggagaatcacttgaacccgggaggtggacgttgcagtgagccgagatcgcgccactgtactccagcctgggtgacagagcgagactccatctcaaaaaaaaaaaaaaaaaaaaaaaaaaaaaaaaaaaaaaaaagaaagagagagagagagagaaagaaggagaagaaaaaggtgccatcttctccacagatgtttgacacgatttaacatctgagttgctattcctggccttgggtaaggtgccggacaccctggtgtgatgatgtgtctgcgaatgatccaccgtcccgccctcgccccagctttgctagctcagcctccagcacgcccttgtaggacgtgtccctgcagccgactgaaaaggtggcctggatgggtgtcttcaagtacggagaactgcggtgtcgcgcctccgggccccatccggctcccagcatcttctcccgctgcggaggccgcatttccactcagggcagcgccgccgcggtggttccgccctgtcgggctcagaccggcctgggcgcctccgcggggagctgggcggtggcgggggccgcgggagtggagccggcccgagcctccagggggcgctggcggccgcttcctccatccgcaggcggctcccggccacgcccgtcgctgagcgtgaggcgatggcggccgagctcagaacactggtccccggaatggagagctgaggggacagatctaagggacatttataactccgcagggactccggggtgggagtcagtccgtctcaggtgcgtctccggaagaacttcggcgtcctcagggaatcagtccctgccccagtgagaaaaaccttgctgggtcctccctgatccccgccactacttttttctccttagcaaaatccagatattgtttgagtattgggcagccacgtgcttcaggggaagctgagccccttcccagtgtgagagttgggggtgagtcttagaataaatcaatcacagcaattttattattattgccgttatcattggtttaggaacggacaggtggcagaattctggcccatgaaatataagaagaggcccactgtggagcttctgaggccgggcacggtggctcacgcctgtaatcccagcactttgggaggctgaggctggcggatcacgaggtcaggagttcgaaaccagcctggccaacatggtgaaacccccatctctactaaagatacaacaaattagccgggcgtggtggcgcgcacctgtaatcccagctactcgggaggctgaggcaggagaatcgcttgaacccagaaggcagaggttgtagtgagccaagatcgtgccattgcactccagcctgggtgacagggcgagactctgtctccataaattaattaattaattaattaattaagacatagtcttgctacgttgcccaggctggtctccaactcctgggctcaagtggtcctcccgccttggcctcccaaagtgctgggattacaggtgtgagccagaaaagtttgtttaaattgtgcaaaaatatacataacaaaatttaccatttttatattttacttactttttatttatttcaataggtttttggggaacaggtggtgtttggtttcataagttcttcagtggtgatttctgagatttggtgcagccatcactcgagcagtgtacacggtacccaacgtgtggtcttttatccctcgcccccttcccaccctttcccctgaatacccaaagtgcattgtatctttttttttttttttttttttgtgagatgtagtctctctgtgtcgcccaggctggagtgcaatggcacgatctcggctcactgcaacctctgcctcccgggttcaagtgattctcctgccttagcctcctgaatagctgggactacaggcacatgccaccaagcccagctaatttttgtatttctagtagagacggggtttcaccatgttgggcaggatggtctcgatctcttgacctcatgattcgcctgcctcggcctcccaaagtgctgggattacaggcttgagccaccgcacccggtccactccgtggctttcttttcatcatcttgatggtgtgttttcatgaactaatgttcttaattttcaagtagtccaatttatcatgttttcattttgatgtcttatatatgaaatttttcctaccccaaggtcatgaaaatatttttttccttttagaagcttcaccactttacctattacatttatatctgtaatatgcctaaaatttagacctttggattaatgtgaagaaggtcaagattcttttcttctccatatggatatacaactgactcaatcccatttattataaagagtttcctcactgctctgcagtggacttttgtcattaatcaagtttgcatacatgcaagcatctatttctatcctctattctgttccattggtctgcttatttattcttgtgcccaaatcacactcaaccttaattattttggcttcattaaaaagtcttaataacatacagtgtgagtcctccagctatgctcttcaagattatctggggtattctgggccatttgcattttcatataaaattttcaataagcttgctaatttttagaacgctatgagctgggatattgagtagaattacattgacatcttcataatatttagccttctaattcatgaatatgatacgtatctttatttagattctctttaattttcctcggtcgtgttttgtagtttcctttgtagagtttttgcatgttttccattagatttattactaggtatttgatgtttcttgatgctgttgtaagtagtgtttaatgtttttcttattgctgttataaatacgaccaatttttctatatttacctttttattcagcaaccttactaaacccatttttcacttagtcgttcatctgtagatgcccgcccgcccgcctgcctgcctgcccgcccacccgcccgcctgcccgcccgcctgcccgcctgcccgcctgcccgcctttcttttctttcgtcttgctctgtcacccaggctggagtgcagtggcgtgatctcagctcactgcaacctccacctcctgggttcaagtggctctcctgcctcagcctcctgagtagctggtactaccggcacatgccaccacacctgactaatttttgtatttttagtagagacagggttgcaccatgttggccaggcttgtctcaaactcctgacctcaggtgatccacccaccttttcctcccaaagtgctggaattacaggcgtgagtcaccgcatccgtccttgttctgcaaacacaatcatgttgtctgtgaatgacagttttagttcttcctttccaattcttatgtctttcatttctttttcttgtcttgttgtaatgtctacaccttcaacagaatgttgaatagaattaatcaagggaatttcattctattctcaaactcctgacctcaggccatctgcctgcctcagcctcccaaagtgctgggattataggcttcattctattctcttgttaccaacatcatgaagaaagtttcagtgttttaccatgtttctaaattattcatgtctcaaagaagaaaatacaatgaaaattttaaatgtttcattgaaaaacaatgaaaatgtgacataagacaataaggaggtagctaaaactgtactttgaagaaattttgtctcaaatgcaaaataaaagctggacatatccgtgagataagtgttcatctcaaggtgttagaaaaagagcaaattaaacctaaagttattagaatgaaggaaataataaagattagagcaggaattcatgaaatagaaagaaataaataatagaaaggattatcaaaggcaaatattagttctttgacccttgtgcactattgatgggaatgtaaattattacggccattatgaaaaacagtatggaggtttctgaaaaaattaaaaataggactaccatatgatccagcaatgatatatactaggtgcatatctggaggaaatgaactcagtgtgttgaagggacacctacactcccacattaattgcagcgttattcataatagccaagatatggaatcaacttaaggagccatcaacaatgtggtatgctaggcatggtggctcatgcctataatcccagcattttggaaggctgaggcaagaggatcacttgtgcccaggagtttgaaaccaggctaggcaacatagtgagacctcatctctacaaaacaaaaaaaaaattaatttgaaaaacaatatgctgaaaaaatgtgctacatgctcatcatggatgacattaaaaataagtaaataagcaatatggtgtatatacacaatggaatactattcagcctttaaaaagaaggaaattctgtcatttgcaacaagatgtaagatcctggacgacattatgctatgagaaataagtcaggcataggaagacaagtactgcatgatctcacttatatgaggaattgaaaaaagtgaaacttctagaagcagggacagagagtagaatgttggttgccagggttggttaggaggctggggagatgggagatgttggccaaagggtacaaactttcaatataacgtgaataagttctggagatctaatacacagcacagtgattatagttaataatactgtattgtatacttgaaatttgctaagagaatagttcttaagtgtgttcattattgggggaaccagcccccaatatttcaacgtaggttcttttctattttccctaagtgtcagctggtctgagaaaaaaagagaaagagtacaagagagagaaattttacagctgggcctccgggggtgacatcacgtgtcggcaggttctgtgatacccacctgagccgcaaaaccagcaggtttttattaggaatttcaaaaggggagggggtatgaatagggagtgggtcacagagatcacacgcttcattcaaatggcaataaaagatcacaagggcataagggcagagcaagctcacaaggccagggcgaaattagaattactgatgaggtttcacgtcccactgtgcacgcgttgtcattgataaatatcttaacaggaaacagggttcaagagcagagaactggtctgactacaattcgccaggctggaatttcctaatcctagcaagcctgggggcgccgcaggagagcagggcgttatttcatcccttatcttcaaccgcatgaggcagacagccccagagcggccgtccatgccccccaccgggaatgcgttcccttcccagggtgattccttgctgggaaaagaatgcagccatatttctcctactcgttttctgcaataagaaagatatgacgctgttctgcccggccccgcaggcagtcagaccttatggttatctcccttgttccctgaacatcgctgttatcctgttctttttcagggtgcccagatttcatattgttcaaacacacgttttacaaacaatttgtgcagttaacgcaatcatcacagggtcctgaggtgacatacatcctcagtttacgaagatgacgggattaagagattaaagtacaaacaggcacaggaaattatgagtcttgactggggaagtgatacatgtccatgaaatcttcacaatttatgttcagagactgcagtaaagacaggcgtaagaaattataaaagtattaatttggggaactaataaatgtccatgaaatcctcacaatttatgttcttctgccgtggcttcagctggtccctccgttcagggtccctgagttcccgcaacaattcatcgcaaaaaaaaaaatggtaagaagctgggcatggtggcgtgtgcctgtggtatcaactacttgggaggctgaggcaggaggatcacttgagcttggcatgggcaacctaccaagaccacatatctaaagaaataaaatgtcttttctggttccacttgagggttgcatttttttaaaagcagactttttttgtgagataatgtatatggtagcaagcttgatttggccactccacatgtaaacatatttcaaaacatcatgttatgtaccataaatatatatattttttgtcattaaaaaataaatttaggcgaggcatggtgggttgagcctgtaatcccagcagtttgggaggctgaggttggaggatcacttgaggccaagagtttgagaccagtctgggcaacgtagggagatcccatctctgcaaaaaattaaaaattagccaggtgaggcagtgtgcacctgtagtcccagctacctgagaggctgaagtaggaggatcacttgagcccgggagtctgaggctgcagtgagctatgattgtgccactgcacttcagccttggcaattgggtgagatcatctctccaaataaataaataaacaatttttaaatggttctttgaaaaggttattgatactgaaaaactcctgacaagattaataaataagagaagtcacagataaccaataacaggattgaagaaggggacatcattatacatgtaaacagatgacaaaaagctaagaggatattataggctgagtgcagtggctcacgcctgtaatcccagcactttgggaggacgaggcgggaggatcacgaggtcaaggagatctataccatcctggctaacacggtgaaaccccgtctctactaaaaatacaaagaattagcccggcatggtggcacgcgcctgtaatcccagctactcaggaggctaaggcaggagaatcgcttgaacccaggaggcagaggttgcagtgagccaagatcatgccactgcactccagtctgggcaacagagtgagactctgtctcaaacaaacaaaaagctaagctaagtttgattcttttaattctgagtagtattctatagtatgggtgtactgtaatttgtttaaccatttacctgtggaaggaatctggcttattccagttttgagctatcacaaataaagctgctataaatatgtgtccaatatttttctggaataaatgcccaggagtgcaattgccagataatatgggtaatacggtagtagcatggttagttttgtaagaaactgccaaactgttttccagagtagctgtaccactgtgcgttcccaccaccaatgtaggagtgactcagtttctccacatactcaccagcatttagtattgtcactattttttatattaaccattctgataagtgcacatattcattttaaaaaatatttcatacagattttgttagtattctggaaggataagttgatttgcaacatgctaaatgatactgtaacctattaaactcattctgtaattggtattgaatcagttttttgacagataggatccagacatctagatagttttaattttatttttattttttaatttttttttttttttttttttgagacagggtcttgctctgttacccaggctggagcacagtggcatgatcttggctcactgcaacctctgcttcctggttcaagtgtttcacctccctcagcctcttgagtagctgggattacaggcgccagccaccaggcctggctaatttttttacttttagtacagacaacggggtttcaccatgctggccaggctggtctcgaactcctgacctcaagtgatccaccagcctcagcctcccaaagtgttgggattacaggcagtaagccactgtgcccggcctagatagttttcagatcaacaaaggtgaatctgatttgcaaccagggttatgaaccactggtctcagaagacgtagctttgagggaagtggccacagtcaatgatgggaagagacaatgggaatacacagtgggatagtagagatgaatgatgtttcataaacataaacaaggatgccatgaccctgggaaataacattttttggaaaataatttttaaacttttgaaattatttttttctttttttgagacagagtctcgctttgtagcctaggctggtgtgcagtggcgcgatcttggctcgctgcaacctctgcctcctggattcaagcgattgtcctgcctcagccgcctgagtagctgggattacaggcgtgagccaccacgcccggggaatttttgtatgtttagaagagacggggttccccttttacctcgttgcactcctgagagcaagatgggtcaccagcagctgtactggagccacgcgcgaaaattcggccagggttctcgctcttgtcgcgtctgctcaaaccggcacggtctgatccggaaatatggcctcaatatgcgccgccagtgtttccgtcagtacgcgaaggatgtcggtttcattaagttggactaaatgatcttccttcaaagggttatccaaggcatctactcaatgaaaaaccatgatcattctttgtacataaaataaacatttgaaaaacccaaaaaaaaaaaaaaaaaaaagagatggggtttcaccatgttggccaggctggttttgaactcctggtctcaagttatctgcccgcctcgtcctcccaaagtgctgggattacaggcatgagccaatgtgctcagccctggaaatttaaaatagattgattgtaaagaaatctacttgggcaaaaaaattttaaatttgaatactgaaataataatggttccttagagccataaagtgtttattaacaagaaatacagttgataaaagatatgtatgattgcccaacttacatagaaaagaaaaaaatggaaaaagttcaggtggtgactagtcaagttaattgattattaaggatatcaaaatctctgggcggggcgcggtggctgacgcctgtaatcccagcattttgggaggccgaggtgggtggatcacctgaggtcaggagttcgagaccagcctggtcaacatggtaaaacccccgtctctattaaaaatgcaacaatcagctgggtgtggtggcgggcgtctgtaatcccagctactggggaggctgaggcgggagaatttcttgaacccgggaggcagaggttgcggtgaaccgagatcgcaccactgcactccaacctgggcgacagagcgagactccctctaaaaaaaagaaaatcaatcaatcaatcaatcaatcatcaatcggcccacctaggaaaattgtggattgtgtcgctagggggcgctgaacctttacagagcaattcaggaagggaaaatttaaaattctcagaaccctacatataacacctctctataaaagacaaggaacaccaagcagaaaattagagtatgttattttaaaaagagcaaatctaagagtaagacatttaggagaaggagaaagagttctgcccagtgcctcctctgccttactctggtaagaggaaggcaaacagccttttccaaacagcccggcctctccggtgggttctgtcacatgccagcaagaatcctgactaataccagaagcgacgtgctatttggagaactggtggtcatgtcacccaaacggctagtcagagccagtcaaggcggataaggtctgagtagtcaaacttgctcaccgtcttgtgctccccacctggattatgaaatcgggatccacccagtcactgaggccagaaacctgggctccattttccactccaatatctcttactgataatttcactagcttttctacctggctaccttagaatttagactgaaaaatccttgtgctccatcagaataactgcttctgcagcaaactgagttctaacctttctaccttctccacatttcccagtatcaccattgaccaagtcctggtctcgaaatcctacaggcccctcaagagaatttttaggacactatctacaagtctatgaactcaagctggagtattgtgtctcctcctcctcctccttcttcctcctcctcctcctcctccttctcctcctccttctccgacagggtctccttgtcttgtccaggttggaatacagtggcacagtcatagctcactgcagccttgaactcctgggctcaagcgatcctccagtctcagcctctcagagtgctgagattacaggtgtgagacaccatactgggctgagtattgtatatttctttctttctttatttcttttttttttttttttttgagacatggtctcattctgtcacccaggctggagcgcagtggtgtgatctcggctcactgcaacctcaacctcctggactctagtgatcctcccacctctcagcctcttgagtagctgaaattaaatgcctggctaatttttgtatttttgtagagatagggtttttgccatgttgtctaggtcggtctcaaactcctgaagtcaagcgatctgcctgccttggtctcccaaagtgctaggattacaggagtgagccaccgtatcaaggctatgagcactgtacaccttctaaaagaaaaaattattacactttcaagatcgattacaattattatactaaaattgtttttagcataatgctgcttaaatatgtctaaacccaatatcaggtgtaaatttcttttctttttttttttttttgagatggagtcttgccctgtcgcccaggctggagtgcagtggcgcaatcttggctcactgcaacctctgcctctagggttcaaacgattctcctgcctcagcctcctgagtagctgggattacaggcgcccgccaccacgcccagctaatttttgtatttttagtagagacggggtttcaccatgttggccaggctggtttcaaactcctcaccccgtgatccgcccacctcagcctctcaaagtgctgggattacaggcgtgagccaccgcgcccggccaggtgtaaatttcttatgcttatagctcttatgcaactataagagcaaaacaaacctacgtattaaatacaaaacaaattacaagtaataaagttaaattgacagcattaacatactatgatggctgatgctgctttgttgaagctaagtcatctctcacatcatagatttcacaaagctgctttacagcaggttcttttgcatttggcaagttgatactaccttgggcagagaaatgactcaatcataaaatttttctctaattgaattacacccatcacttggtttatgcattctcagtttataaattttagatgaaaaaaatctgaatatatatacctgtcatttattttaaaaattttagatgttgtttgttttcaaaccgaagatactctatgatatgttatggaagatacattcttccgtcacttctcctaccaccgtgatgaatagagaactgatggtggaacactggggaaagaggttattggcccttgttttgagtgactgttaactctggggggactgtgtctgctgagaaaccagtcaaggtgtttctgttgaacacatgcccagttcaaactctggctagtctcaaactcctgggcttaagtcatcctccagcctcagcctcctgagtagctgggactacaggcatgtgccaccatgcccagcttgtattattatttctttttttttgagacggagtttcactcttgtcacccaggctggagtacaatggcgtggtctcagctcattgcaaccttcgcctcccaggttcaagcaattctcctgcctcagcctcctgagtagctgggattacaggtgtgcaccaccacgcctggctaatttttgtatttttagtagagacagggtttcatcatgttggccaggctggtctcaaactcctgacctcaggtgatccacccacctaggcctccaaaagtgctgggattacaggcgtgagcaaccacacccggcctgtattactatttctaacatcataacttcaaacgagacaaagaaaagatggaaaaagtattaatttaagttgtgaagcctaattttaaaaatccttattttaggccgggcatggcggctcacatctataatcccagcacttttggagaccgaggcgggtggatcatttgaggtcaggagttcgagatcagcatggtcaacatgatgagaccgtctctaataaaaatatgaaaatttggtggctcacacctgtaatcccagccctttgggagaccgaggtgggtggatcacttgaggtcaggagttcgagaccagcctggccaacgtgctgaaaccccatctctactaaaaatacaaaaaattagccaggcatggtggtgcgcgcctgtaatcccagctacttggaaggctgaggcaggagaatcgcttgaacctgggaggtggaggttacagtgagctgagatcgcaccattgcactccagcctgggcaacaaaagtgaaactccatctcgaaaaaaaagaaaaaagaaaaaggccgggtgcggtggctgatgcctgtaatcccagcactttgggaggccaaggcgggcggatcatgaggtcaggagatcaagaccatcctggctaacacggtgaaaccccgtctctactaaagattcaaaaattagctgggcatgctggcgggcgcctgtagtcccagctactcgggaggctgaggcagaagaatggcgtgaacccgggaggcagagcttgcagtaaactgagatcgcaccactgcactccagcctgggtgacagagtgagactctgtctcaaaaaaaaaaaaaaaaaaaaaccacacacacaacaaaaattagccaggctggtggtgcgcacctgtaatcccagctacttgggaagctgaggcaggagaatggcttgaacctgggagatggaggttgcagtgagccgagatagcaccactgcactgggtgacagagcgagattctgtttccaaaaaaaaaaaaaaatccttattttaagtgaaaaattagtagaattaaagtaaatcaagacaatataaacattaatggtggtgaaagcttgaagctctagtacaagagatttggggtagtaataggtccagaaaaagcagtaagacacttgtcttgaaactgcactttgtagcaagcaacctttaaaaaacttaagttttcagccccgattcagtggctcacacttataatcctagcactttgggaggctgagcccagaggattgtttgaggccaggagttcaagaccagcctgggcaacatagcaagaccccatctctaattttaaaaaataaaaataaattagttttgagatataacttacatacaataaaattcaataatttaaaaagtatggcttactgagctctgacaaatgtttacagtcatataatgactgccacaatcatgataaagaccacagaatatcccccatcaccctgaaaacttcccttgtacttctttgcagccaatcctataccctgcctctgacccctggaaacctctgagctgctttctgttttgccttttccagaatgtcatataaatagaatcatatagtatttggatataaatggaatcattagtatttagtctgctaggcatatacttgcttctttcacataccacaatgcttttgagatttgtccatgttcttgcctgtgtccacaatctgttccttttattgctcaatagtattccattgcacggacacactgtgagtggttgaacagttgagggacatttgtgttatttccaatttggctattatgaacaaagtagctataaacatttgggtcaagaattttgtgtgaacgtattttttcatttccctttaaaatttttttattatttctttttcttttcttaaaaatcccaaatgtgatagtattttatttttcttgagtaaatacctaaaaatagaattgctaggtcatattataagcatatgtttagctttaaaagtggcccaactgctttccaaagcggctgtaccattttgcattcctactaacgatgtgtgagagttcccgttgctccgcattcctgtcaacattgtcagtctttataagtgtagccattctagtgggtgtatacaggtgttacattgtagttttaatttgcatttacctaatgactattcatgtcatgcaccttttcatgtacttattggccatttatatatccatattggtgaggtgtccaaatcttttttttttttaattatacttaaagttttagggtacatgtgcacattgtgcaggttagttacatatgtatacatgtgccatgctggtgcactgcacccactaactcgtcatctagcattaggtatatctcccaatgctagaggtatccaaatcttttgcccatttttttttttttaatttttatttttattgatcattcttgggtgtttctcacagagggggatttggcagggtcatgggacaatagtggagggaaggtcagcagataaacaagtgaacaaaggtctctgattttcctaggcagaggaccctgcggccttccgcagtgtttgtgtccctgggtacttgagattagggagtggtgatgactctcaacgagcatgctgccttcaagcatctgtttaacaaagcacatcttgcaccgcccttaatctatttaaccctgagtggatacagcacatgtttcagagagcacagggttgggggtaaggtcacagatcaacaggatcccaaggcagaagaatttttcttagtaaagaacaaaatgaaaagtctcccatgtctacttctttccacacagacacggcaaccatccaatttctcaatcttttccccacctttccccgctttctattccacaaaaccgccattgtcatcatggcccgttctcaatgagctgttgggtacacctcccagacggggtggtggccgggcagaggggctcctcacttcccagtaggggcggccgggcagaggcgcccctcacgtcccggacggggcggctggccgggcagggggctgacccccacctccctcccggacggggcagctgccgggcggagacgctcctcacttcccagacggggtggctgccgggcggagggtctcctcccttctcagatggggcggctgggcagagacgctcctcacctcccagacggcgtcgcggccgggaagaggcgctcctcacatcccagacggggcggcggggcggaggcgctccccacatctcagacgatgggcggccgggcagagacgctcctcacttcctagatgggatggcggccgggaagagacgctcctcactttccagactgggcagccaggcagaggggctcctcacatcccagacgatgggcggccaggcagagacgctcctcacttcccagacggggtggcggccgggcagaggctgcactctggacttttgcccatttttaaattaggttttttgtcttctttttaagttgtaagagttccatatgtatagattctggatataagctctatagtaggtatacattctacacatattttctcccagtctgtggtttgccttttttttttccttttcttttctttctttctttctttttctttttctttttttttttttttcagacagggtctcactctgtcacccaggctggagtgcagtggcacgatctcggctcactgcgccctgcgtctcctgggctcaagcaattctcccacctcagcctcttgggcaactgggactacaggcatgagccaccacactcagctaatttttgtatttgttgtagagacggagttttaccatgttgcctaggctggtctcaaactcctgaggtcaagctacccactggcctgggcctcccaaagtgctaggattacaggcgtgagccaccacacttggccagcttttcattttcttaatagtttttttttggaagaacaaaacttttccactttgataaggtccaattttccaattttttcttttacgcttcatgttttttgtgtcttaagaagtctttgctgaatgcaaggtcgcaaagatcttcttttatgtttcctacattttagagcattagctcttatttttagttttatgacccattacttatgatgtaacagttgaggttcattttttggcatatggcttccaattgttccagcaatacttgttagaaagactaaaatttcccccattgaataaccctggtacctttgctaaaaatctgtttgccatgaacgtgtaagcctgtaagcatatgaagggatgcagaacatcatcagtaattagggaaatgcaaattgaaactacagtaagattctacttcatacccactcagaaaactataattaaaaaaagacaggctgctgggaatgtaaaatggtgtagtcactttagaaagccatctggcagttcctcaaaatatgaacacatatttaccatatgacccattagtttcactcctaggtatatacttgttcatagcagcattattcagaatacctcaaaaacagaaacagtccacatactcatcagctaatgagaagataaacaaattgtggtatagtatatgagtacaatggaatattattcagccctaaaaaggaatgaagtactgatgcatgctaaaacattatcgtgaaaacataatgctaagtgaaagaagccggcctgaagaaacttcatattacatgagtcaatgtatatgaaatgtctggagttggcaaactacagagacagaaagtggagtaacagttgcctagggtaggggtgaagtggtggtataaggtgaaatgggaagtaattgctaatgggttccaattgtttccagtgaggtttctttttgggagaagataatttttttcttcttttttttttagacagtctgtctctgtcacccaggctgggagtgcagtggcacgatcttggctcactgcatcttctgcctcctgggctaaagcaatcctcctgccctcagcctcccaagtagctgggaccaccagcacgcaccaccacgctcagctaatttgtgtgtgtgtgtgtgtgtgtgtgtgtgtgtgtgtgtgtgtgtgtttgttttggtaggagagggttctcccaggctaggggagaggaattttctaaaactaggttgtggtgatgctgcacgaccctctcaatttattaaaagccatcgacttgtatactttattttttctgtgaactttgtagagaagtagatttgtgtactttaagtgggtaaattatatggcatgtgaattatgcctcaataaggcagtttttaaaatcaaaaaatgtataattgttgaatttaaaagattgttccggctgggcatggtggctcatgcctgtaacagcacttggggaggctgaggtgagaggatcacttgagcctacaaggtcgaggctgcagtgagccatgatcgtgccacacactccagcttgggcaacagagcaagacctcgtctcaaaataaaatagttttgttccttaaagttatattcttgtttccactactactatgaaacaattatttccagtgtttgaaacggcagctgtgtgtcttctctctgacattgttaaaattttttctaaagtcacagcacacacacacacacaggcatactaagaaagaaagaaaagtttagtaagtaagtttagtaagtttcattgatgggtcaattacataaagaaacagcaagtgaagtaaaaataaagtacactggagaacctgcagaccactgggaatcccaactgacctgagtttcaatctggttgctcccctgacgcatgggtgtcacctgaccagtgagagtatggaactgctgcctcctccccaagcctctcctgtacaggaagacttcagtcctgtagccttcccagttctcctgcatatcatcctgtgtttttatattagaaacaacatttccccagaggtttaatttctgctttgaaagatctatatgaaagagccaagatacagttaagaaggaaggaatgtgccatcatctgtgtgtttaaaattctgtttcggggctgggcgtggtggctcatgcctgtaatcccagcactttgggaggctgaggtgcgcggatcacctgagatcaggagttcgagaacagcctgaccaacgtggtgaaaccccgtctctactaaaagtacaaaaattggctgggtatggtggtgggcacctgtaatctcagctactcgggaggctgaggcaggagaattacttgagcccagaaggcggaggttgcagtgagccaagatcgcactactgcactccagcctgagtgacagagcaagactctgtctcaaaaaaataaacagagagtctgtgaactcagaaggcatacaattcttataaacacttttcactgtgttaaatttataatgttacatatttgacagtgcattcatagaaattctaagtacttagtagctaaacgtaaaaaaagtgcacttaatttttaggccactacatacctgtgaccagttgtgtcaacatttgtaaatcaataggacttgtatttacttgaccactccacgctctggatgcttctttattcactgactagaattacaggaaaatcgtgcccaagtaaacttcgggttcaagcggtttttttggctatggagaggacttgattagagattcagccccagcccagcccctttcctcaccaagagtaagggaatagcaggggctctccttaagtactggggaggtggtctgtatttttcctgcatgctctcctgggcctagattcaatcttgctcctctggctggatatgacccaggtggtagtggtgatggcagcgtatcttgttcactccagctgagactctacactattccataatgcccctctggcctagcaacttagtctctaagtgaactctagctcagtgaaagggacaatcttccccagctgggaatatcccgcaggaagagggttgactagaaagaaggcctgtctctgctcaaaccccagactgagctacaggtttctcttgtccccagcctctcacctccataagccctgctcatggctgctgaggggcttgtcttctgaccagttctggctgctaccctctcctgccaccagggcttttgtgcagtaaggatggcatgaggcataattgctagtcaagaccaagaatgtgagttattgctaagtttctcatacatgatatcagtattatggttatactggaaaatgtccttttttaggagacgcatgctgaagttttgagatcaagtgtgacatggtttgagtgtccccactcaaatctcatcttgaattccatgttgtgggagggacccggtgggaggtaattgaatcatgggggcaggtctttcccgtgctgttcttgtgatagtgaataagtctcatgagatctgatggttctataaggggattctaaaattagcttgtggtgatgccagtaagacctcctcaatttattaaaaaccattgacttggccagcgtctctactaaaaatacaaaaattagctgggcatggtggcgggcaagtgtaatcccagctacttgggaggctgaggcaggagaatggcttgaacctgggaggcagaggttgcagtgagccgagatcatgccactgcactccagcctggcaacagactgagacacggtctaaaaaaaaaaaaaaaacaccactgacttttatactttatttcttctgtgaactttgtagagaagtagatttgtatactttaagtggataaattgtacggcatgtgaactatacctcaataaggcagtttttaaaatccaaaaatatgtaattgttgaatttaagtttgttccggctgggcatggttgctcatgcctgtaagagcacttggggaggctgttatattcttgtttccactagtaatataagggggagtttccctgtacaagctctctctttgcctgctgccatccatttaagatgtgacttgctcctccttgccttccaccatgattgtgaggcctcccagccatgtggaactgtacatctattaaatcctttttcctgcataaattaccaagtcttgggtatgtctttatcagcagcatgaaaacgaactaatacagtaaattggtaccagtagagtggtattgaaaagatacctgaaaatgtggaagcgactttggaactgggtaacaggcagaggttggaacagtttggggagctcagaagaagacaggaaaatgtggaaaagtttggaattccctagagacttgttgaatggctttgaccaacatgcttataatgatatggacaatgaaatcgaggctgaagtggttgcagatgaagatgaggaactcgttgggaactggagtaaaggtgactcttgctatgttttagcaaagagaatggtggcattttgcccctgccttagagctctgtggaactttgaacttgagagagatgatttagggtatctggcagaagaaatttctaagcagcaaagcattaaagaggtaattttggtgctgttaaaagcattcaggtttttttttttttttttgatatggagtcttgctctgtcgcccaggctggagtgcagtggtgcgatctcagctcactgcaagctccacctccagggttcatgccattctcctgcctcagcctcctgagtagctgggactacaggcgcccaccaccatgcccagctaattttgtttttgtatttttagtagagacagggtttcaccgtgttagccaggatggtctccatctcctgatcttgtgatctgcctgccccggcctcccaaagtgctgggtttacaggtatgagccaccacacccagccagcattcagttttaaaagggaaacagaataaaaatttggaaaatttgcagcctgacaatgcaatagaaaagaaaatcccattttctgaggagaaattcaagccagctgcagaaacttgcataagttaagaagaagccaaatgttaatccacaagacaatggggaaaatgtctccagggcatgtcagaagtcttcatggcaacccttcccatcacaggtcctaaggcctaggaggaaaaaatggtttagtgggtcaggcccagggtccccctgctgtgtgcagcctagggacttggtgccgtgtcacagccaatccagccatggctaaaaggggccaacatagagcttgggctgtggcttcagagagtgcaagcccaaagccttggcagcttccacatagtgttgagcctgtgagtgcacagaagtcaagaactggggtttgggaaactctgcctagatttcagaagatgtatggacacacctggatgtccaggcagaagtttgctgcaggggtggggccctcatggagaacctctgctagggcagtgtggaagggaaatgtggggtaggagtctccacacagagtccctacaggggcaccttcaggtggagctgtgagaagagggccaccatcctccagaccccaaaatggtagcttcactgatagcttgcatcattcacctggaaaagccacagatactcaacaccagcctgtgaaagcagctgggaggctgcaccctgcaaagcacacaggggcagagctgcccaagaccatgggaacccacctcttgcaccagtgtgacctggatgtgagacagagagtcaaaacagatcactctggagttttaagatttgactgccctgctggattttggacttgtatggggactgtagcccctttgttttggccaatttttcccattttgaacagctgtatttacccaatgcctgtacccccattgtatctaggaagtaactaacttgcttttgattttacaggcttatagaggaagggacttgccttgtctcaggtgagactttggactgtggatttttgagttaatgctgaaataagactttgggggactgttgggaaagcatgattgggtttgaaatgtgaggacatgagatttgggaggggctgagggtgaaatgatatggtttggctgtgtctttacccaaatttcatcttgaattcccacatgttgtaggagggacccagtgggaggtaattaaatcatggggacaggtctttcccatgctgttttcatgatagtgaattaagtctcacaagatctgatggttctataagggggagtttccctgcacaagctctctctcgggttgcctgccgccatccatgtaagacatgacttgctcctccttgccttgcaccatgattgtaaggcctccctaaccacgtggatctgtaagtccattaaacttttttcctgtataaattatccagactcaggtatgtctttatcagcagcatgaaaacagactaatacaaagtgtcaaggtacctcactttcaaatagttcagcaaacaagacacacacacatacatacatacaaaacatatgtgctgtgcattactgtttttcactaattctttccttgtaaataggaaaattgtggtcaagggagagctggtcataggctgatggcaccagaactacacgattctgccagaatgtgactgattaatcctgaaaagtatttctgcccttggcaaggagtggttgggtggccctgtatcagcctcaagtttgtgcatccaggaccacaaactgattgtaatttggagagggtacatgaaatgtgaaataatttggtaggccagggtgggcggatcacctgaggtcaagagttcaagaccagcctggccaacatggtgaaaccccatctctattaaaaatacaaaaattggccaggcgcagtggctcatacctgcaatcccaacactttgggagtccgaggtgggtggattacttgaggtcaggagttcaagacaagcctggccaacatggtgaaaccccatctctactaaaaatacaaattagctgggcatggtggcgggcacctgtaatcccagctactcgggaggctgaggcacgagaactgcttgaacctgggagatggaggttgcagtgagccgagatggtgccactgcattccagcctgggtgacagagtacaactccatcttgaaaacaacaacaaaaaaaattagccaggtgtagtggcaaacccatgtaatcccagctattcaagaggctgaggcacgagaattgcttgaacccaggaggcagagtttgcagtgagccaagatcatgccattgccctccagcctgggtgacagtaagactgtctcaaaaaaaaaaaaaaaaaagaaaaaagaaatgtgaaatgagcatgtttaggtgtctgtgagttcagcattggttaggagaatgtgtagccctgatagctggcgttaaaaataatctgaagaggctgggtgtggaggctcatgcctgtaatcccatccctttgagaggccgaggtggggatcacctgaggtcaggagtttgagaccagcctgggcaacatggcaaaactgagtctctaccaaaaatacaaaaattagctgggtgtggtggcaggtgcctgtaatcccagctactcaaaaggctgaggcaggagaactgtttgaacctgggaggtgtaggttgcagtgagctgagatcatactactgcactccagcctgggtgacacagcaagacttcatctcaaaaaataaaaataaataaataaaaataaataaaataaaaataacttgaagaacaagcaaagggttgggtctagttgtcaggcaatcctgccaccagttcccttcaggcttttttttctaaccacattttaactttctggatctcctttgattcatttaatatcttatgagtactgtttgtgttggctgggaagcctaggacaggccacacgatatgctctgaagtgaaagagggtagtctttgccttcaagcatcttacactctaataaaaatagaaaagcacgtagttatgcctcggtactcatgggttccacagtctgtggagtcaatcaaccgtggctcaaatgtcttcggggaagaaaaaacaacagaacacaactatacaactatacaatgataaaaaataatacaaataaaaaatacagaatactatttatatagcatttccattgtattaaggattataagtaatcgagatgatttaacgtttataggaggacgtacataggttatttgcaaaatattattttaacataattctttaagattcataaattaatcggatctgcaaagatccttctgccaaatgtttataaatttacttataattaaatataaatattaataattaatattatcaatattatttaagttacatagcaatctcataatattcacaatattttaaattaaataattaaaatttatatttaatggtaataagtaatacaggttccagtgattggaacctgttatctttggaggatgtttttcagccttctacaggtgggggacattgaaagcttgcttccgaggggtgaccactgaagttcctatttgtcaccttgagtggccatttgactattagaactaagttatattcaaaatgatgtcctggttctctgtaaacttaggctggggtgcttcttttgcttaccctgccagcgtagccgcctcagcagtatgcacctgactgttcttggacttctcagctatgtgagccaatacattcctttttattctgttaagccaatttgaatttggtttctgtcacctgcaacaggagtcctgactaaaactgaatttatgaaaaagagatctccacaaacaagaataatggtaaccaatcagatgatctcttcaaagctttgaatataggccaggtacggtggctcacacctgtactcccagcactttgggaggctaagacaggaggattgcttgaggccaggagtttgagaccagtttggccaacatagcaaggctcctctctataaaaaaattaaattaaaatttaaaaaactctaaatataagagtaggcagtatgagtgaaagctgaaagaacatgcagagaagacagcaatccaggcctcaatgaaaaggaacataactcttgacaccctatctaggcctctattctcttttctatcttctgcttcgtcagaatttctgcttattaataactgcaacttattctcactccaccagcatcatggcctggattgctgcataataccctaaactgatttgaccctggaaccctttttgttttttagaaacacagcaaaaggtaattgtcagcaaagcaatttgggctttacacagaacaagcaagaacaggtttcctcttccaacttggtaatgctcctcatgacatcctgggatcagaaataactaatgttatttatttatttatttagagacagagtcgctctgtcacctaggctagagtgcagtggtgtgatcttggctcactgcaacctctaccttctgggttcaagcgattctcccgtctcagtctcctgagtagcttggattacaggcacgtgccactaggcccagccaatttttgtatttttagtagagatgggtttttgccatgttggccaggctggtttctaactcctgacctcagatgatctgcccgcatcggcctcccaaagtgctgggattacaggcgtgagtcactgcgcctggacagaaataactaatatggtgaccaatttggaccaggatgtgggcttccctacggtaggcagcttaacaaggtcctttccagacaagtcgttgtgcctgcaattttcctggatctttaagttacttaacatttctaagtcttaattcctgtggcactaaaatgggggaaatcacttcaatgattcggaacaagaaatcaaatatacgtaaaatggctggtacatggtacacaatgaatattcattctcttcctccaaactttaacatatcacttactatataaatatccaattgtcttttgttcaaatatcttaaaatttgtacagcagaagagtatgattttacatataacaaacagcttaaataaagaaccaggagcttttttttttaatctgaaaaacagttttgccacaattcttcaaatgtttttattggatttaaaattcatttaaggggtatacagatatacaactagtttgatcagctactaatatattttggtgtccctttatttttgtacccaagagccagttcactttttctccatgttcaatatttagctttggtaaaatgttgccatgttcttcctcatctgttactgaagcgttagtatttccaccctgcttggtgcaagttcctcttttaggtttcttcctgtgggtacgttttgtgggactcttctgttttttctcaacttcactgtttgcatcccacaacgtgatcttcccatcattccctccagtaagcagcaaataggattctgggagaaagcagacctgggatacccctgaagtgtggcccttaaatcccagttcctgttcacacttaactcccatcacccgaaagattcgaaccttaccatcttctgcaccacaactaaaaatattaccacacgaagccacagagatagaatgggctagggcagggtttaagagctgaccaggtgactgtgggccttccatttcttctgtttcatcctcctgtaaatttgtaatccagagtggtcgggctttttgaagactccacagcatcacctttacataagaagaaattacacagtcatacaaaatgctagccaatttgctcaactatcatgcttattcagcttctaataaaatcgttaaagtagtctgagaatgagcagtagtgcacgttctcagcagtattaaaaaataatcaaatgctgccataacatgccagtggaatgctaccccgggactaaaactagagtgcggttaggtagaattaaacaagatcctgaataatttttgattaataaactccattaaagtgtaattgttaagcagctgccagtttctaaaggtttttctgctctcatctcttcaagtaaaaccaaagattatcaaatttgctagttttagtctatgctggttataggtcaaaaggcctatcaactaaataaactcgatctggactatcattgaaatgctttccatctggaatgccttcctttcctttcacattacccaattacccatccaaggggcttaagctcagtcctggtgcctccaagaaggctttcctatttcagcccgcttctccttcctgtatctagtttctattctattaattgacatattctactagcttatcagtttcttgagacttacttagtctttgctaatgcctagcataatggctgagaaagaggagaaattccaaacatgtctgttgattaatatgacatcctggtattaatttcatttggcttttcgttgttcccgacctggtgctttttgttttttttaaataagctttgtgaatgggttttacattatcatctagtgattcattcttttcctgtatcaaccattttgcaaagaaaaatactcttaatactttcaaagcaaacagacagctttatcatgtagtttaccatcatccctgaattataactcacaattttaacagacactggaagaagcatgagcttgtttagacagtgaaaagcatagatctgaattggcaagattactattgctaatgctattaagaatttggtttcctattcaaggtaacttcccttatgattattctcagtggcctattttcaaaagcagtgacatctagtaacacttacattctgcttctcttagatgaaaatctctttgaattggatttataacattatactatgtgactaacaatcactgtttgggtgaagttaaagtacgaacaaattgaaataagctaaagtaaaataaataaatattagaaaatataacacgaaggagtgctgaaacttgatatgaaaatagttttttttttaaaaatagggtctcactttgtcacccaggctagagtgcagtggcatgaccatggctcactgcagccttgacctcttgggttcaagtgatccttccacctcagcctcccaagtagatgggactacaggcgcatgctaccacacccagctaatttttgtatttttttgtagagatggggtttttgctatgttgcccaggctggtctccaactgctgggctcaagcgatccactcatctccacctcccaaagtgatgggattacacgcatcagccacaatgccccaaaacagtttctattaaaaaatctgaacacggctgggcacggtggctcacacctctaatcccagcactttgggaggctgaggtgggcggatcacgatgtcaggagatcgagaccatcctggctaacacagtgaaactgcatctctactaaaaatacaaaaaattagctaggcatggtggtgggcgcctgtagtcccagctactcgggaggctgaggcaggagaatggcgtgaacctgggaggcagagcttgcagtgagccgagatcacaccattgcactccagcctgggcaacagagcaagactccgtctttaaaaaaaaaaaaaagaaaatacacacacacacacacagaaaatggacattctagaatctgctagcttcactgtattggcagatagacccagttctttctcatacagcccttatgaatggactgtattttctgtcctccaaagacattcaaacatgcactgcacccagagtgtttcagcagctgaaacaccttttgtatttgacttaaatcatctaaatgtgttaacagccatcccagattctaccaagtctagaatcatttccacgtattgaggattccagactgttcctgtctggacattccctttatgcttcttgacttttctaaaatgctaaagactccaaggtgtttcacacttaatttctcaaccagctgttcaagcagttctcatcctaatcaagagagctagagatactgaaagaaaagaataaagagtttggggcttatggttctgcaaaacatcgaagggagaaaaagtggggaaccagcaaatgttcagaagtgaatgtaatcataacaaagtgacctttcaaaacaaattccccttttacaaaaacatttctttccacataaaagactcgtcttcaagataaagagcctcttcaggccaggtgcagtggctcatgcctataatcccagcactttgggaggccatggcaggactgcttgagcccaggagttcgagaccagcctggggaacacagggagccagccctcctctgcagcaaaaataaaaaaaattagctgggtgtgtcggcttgtgcctgtagtcccagctatgcaggaggatgaggtgggaggatcacctgagggagtgcgaggctgcggtgagctctaattgtaccactgcactccagcctggatgacaaagaccctgtctcaaaaacaaacaaacaaaagagccttctctaccatcctggtctgtaagtgttgggattttggttttaaaaatccagaaagaacaacaaacctttcaatcatttgttttcagatgcagaaaggggcagggaaagaaaatcaacatgtatgctacagaaatatgacagttttaattttctaagtctttcaagaaaaaaactatagttgaatggtaggtatacaggtatttatttaattttttttcttttctttttttttttttgagacaaggtctcactgtcacccaggctggagtgcagtggcacaatcttggctcactgcaacctcaacctctcgggatcaagcaattctcccgtctcagccccccaagtagctgggactacaggtgctcactacacacctggctactttttgtatcttttgtagagatggggtttcgctatgttgcccaggctggtcacaaactcctgagctcaagcgatccacctgccatggcctcccaaagttctgggattataggcatgagccactgcgcctggcctaatgttatcctttacacctcatatatataaatattactttgtacctattaaataaaaaattaagcagtctcacgtgtcttaaagaaccacactttgcttttagggtccctgcctctttgaatgcgctttgcctattttatttttttgagacagggtctcactttgtcatccaggctggagtgcagtggcgagatcatggctcactacaacctccacctccctgggctcaggtgatcctcccacgtcaacttcctaagtagctgggaccacaggtggatgctagcacacctggctaattttcgtattttcggtagagatagggttttgccatgttgtccaggctggtctcgaactcctgggctcaagtgatctgcctgccttggcctcccaaagtgctgggatcccaggcatgagccctcaggcacataagctaccacacctggccctgcctaattatttaaacctaagtcaaaagacataactttataattactgttacataagaaaaaagataggtatgctgaacatggcaatcattcaattcctgccttgagataaaatttgtttgctcagagagaagtaactcaaaatagtcagaactcccttccactattactgtgcctacattcttgggctcccccatagactggctatccttaaagtttaggataatactggatcaacaggttttaggaagacaactgtggaaataattatagagtttcaacttcagttaaggaagtcatttcttaaaagcatggttgtatggctgttacatcacaacccagtgtagaaacaaatctaccatgaacctttagcaattttaccaggcaaatcaaaataagaaattacctgagcctccctttttcaaaatacttgtttccagggctgttcactagcaagtgcctgccactaaaacgtcttacctggaactgggggcaagacagtaaattctgaatgcccattcctcatctaatctgaaaagtacacatcacttttgcgtacccaattgtctattgccatgcctagtggttaatgaaccactgatggaaaagtggtacagctgaaggatgacagaatgactactcaaagacacactgtacaatctgcctacttaaaacatatccatctggttgtataggtctttctttacaaccacaagggcagattatcaccactagggtggagaatgtaggagatttataaagggcttggtcaaaacctaggagtggaaaaggaagatagaggttgtagggtcactatgccccatacatgtagagtgagtctcaacccaggcactacagatgtttttggggagacaattctttattgtttggagactatcccagcactgcaggacacccactgattctgcctactgaatactggtagcttgcaggagaggggaacagcatggtgacaacaaaaacagtctcatcattcttcagttatgaggggtatgcagggttggggagggaaaggtaaagaccactagccaagagggtggaagtcataactgatgctattaaaaagaacatggaatcttagaagatactgtatgtaactgagaacagagattaaatgcctgaacagtgctggacacatcggtcattcacaatggttctctctctagaagccacctgaccccaaaccaagaaacttttctgtgacattattgatgatactctgcttgaatacctgtcatcttagagaaaaaacatagcctttggagccagagagattgaggtttgaatctcagtcaggtggcaatgtagatacttcatgtgaatttcagtttctttatttattaaaaaaaataactaggagggtgtgattagaattaaaactaatatacacaaagcattggcaagaactaagtgctcaacagacagaaatcatgacgactcactccagtgatgagatttactctctcaagaggaagcacatcctgccatgggaacgttcaagctatttgaaaacgtttacattaagcccaaatctgctttcccatgacttctcttatgaagaccagcacattccattttttcccctcatgaaaactaagaattaaacacctccagttctctacataatgggtttctagatacatctactctcctgatggacttcctctgtatttgggcaatttgtgatgctcctttcttttttctttttttttttttgagacagagtctcactctgttgcctaggcaggagtgcagtggcatgatctcggctcactgcaacctccacctcctgggtcaagcgattctgctgcctcagcctcccaagtagctgggattgcaggagcccaccaccacgcctggctaatttttgtatttctagtagagacagggtttcaccacgttggccaggctggtcttgatgacctcaagtgatctgcccacctcggccttccaaagtgctgggattacaggcgtgagccaccgtgcccagccgtgatgctcctttcaaaactcagcattgaatacagtgctctgatcctgatcaccaatacacactatttcagttaatgtaccccagaactttaaagtaaaaacagacccctctaactttttgtttaaacagagtttacagagagtgggtggaccaactctgcctttagtactcactgtttgtttaaacagatgtttacaatcaaatatttgcattttcaggttttaggagtatcttacagtatagagaaaggaaaagtaaaggattaatgattactttgtgaataaattctattaggttttatcagactagcattaaatgtagaaataaggcttattgttcataaatggatatgttagtagaaaacagaaaaagcaaagatatttcgtgtgatcaataatttgatcctgttagcaaatcccacttagaaattccccaagtactctgtgcaaaagcatcacctgcatatccagtccacatgacaccaggctctgaggcctctgaggccgaaaagccactgaggagcagatattggaatgtctcttcaaggatctgataactttcttgttttccaagtctaggattttgattgccccagagtcgtcagcagaagccagcaggttttccgtttgattcaatgaaagacaattgatttcttcttcattcacatgaaaatggtccaaggaatctttgagggacctgacatccagtacactaatggtttctccatgtgaggcatagagcttggtgggacaggagggagaaaataagacactggtaacatcatcagccccttggaaccgcgtgtgtcctaatggagttccatcttcaccccaagccgtgagatctccgccctctgctccagaagccagcagcccttctttacttgcattcaggcagaggacaggagaagaatgcccacccgtccacttgactgccataatggtcccggagactctgtgaagtgggggaaacaactgtaatctcatgttttatacatcgacttgatgggaggagacagatgtaataaacaatatttcatcttttaaaatgttttaaaaatacatcttaaaaaaactcaattaattaaaaaaaaaaaagacacttaaagatcacatctccaaaagcctagctgaacacagggttgtatcctggctggcaaatacttcagtgggcttcctttgccatcagggatctaggtaaggccagtcctccagtctttcatatggaacccacagaagaataaacactacatattttaaattaagaaaaattattttaaagagagggctgcaaaatcatcaggttatgcctcttatctgaataatgttttagatggtgagctctgcagctaggctctccaggtttgcagtagctaggggactgggcaaattactgaacctgtcacccacttttcttctctataaaatgaggataataatgacactcatttcataggatcataatatatgtaaatcacacataatagtgcctgatacataatgaatcctcaacaagcattgctattgttactttttcgatttttattaggccggtgcaaagcggcattacatacactgcaccagtactctcaaagtgtggtctccacactagcagcatcagcatcccctaggaacttgtcagaaatgcaaattgtcagacccaaccctagatctactgaatctgaaaatgggggtgagaccaagcagtgtgtttttgttgttgttgttttgttttgttttctgagatggagtctcgctgccgttagcccgggctggactgcaatggatgatctcggctcactgcaacctccgcctcccgggttccagcaattttcctgcctcagcctcccgagtagctgagataacaggcacccggcaccatgcctggctaatttttgtatttttagtagagacggggtttcaccatgttggccaggctggtctcaaactcctgacctcaggtgatccacccaccttggcctcccaaagtgctgggattataagcgtgagccaccacgcccggctgcaatgtgttttagtaagtcctccaggtgatcctgatgtacagtggaattgcagaatctgtattaaactaatgaccacctggggaaatggtgaaaatggcaggcccttggtctccccaccagacacttattcagtaggttatctaattttatctcaaaacaacccttttgattggtattattccattttagggataataaaaccgagtctcagaaatgttaaataattttcccaaggtcacttgactcttaggatttgtaacagatcccaaatgttttgtttttgttttgagacagggttttgctctgtcacccaggctgcagtgcagtggcacaatcgtggctcactgcagccttgacctcccaggcctaagcaatcctcccacctcagtctcctgagtagctcagaccacttatgtgcaccaccatgcctggctaatttttattttattaaatttttttttgcaaagtcggggtctccctatgttgcccaggctccaaatatttaaataatgaaggtccttttctaacaactccacctgacaacagttttgttattattctttgaagaaacagaaaatgaccaaaagttactagtaagtcatcagtgcttgaaaatgtactcacatatgtttaatcatattatcatctacctgcacttacacaacagtgtaaaatttagatttctcatcctctaggaatcccagatatacacacactggaaatgccacataataccggcctgccgtgcccgcctgctggtcaaggcaaaaaggaaatcagggcaatttatacaactctaatcttggtcaagacaaaaggaagcaaataaatctacctggacaaatttaatttttcatttcataagcgaaaggagagcttacccgagtgccagcccccagagctgttgtgctattttcagataagatacttgaatttagcccagtggtacagagataaaatcatttaaaataatctggcaatctgcccaaagtttccattcccaacacaaagcttttttttttttttgagacggagtcttgctctgtcgcccaggttggagtgcaatggcacaatctcagctctctgcaacctctgcctcctatgtttaagcgattctcctgcctcagcctcccaagtagctgagattatagacgcctgccaccacgccaggctaacttttccatttttagtagagacagggtttcaccatgttggccaggctggtcttgaacttctgaccttacatgatccacccacttcagcctcccaaagtgctgggattataggcgtgcgtcaccgcacccagcctccccctacttttagtcacacatacgatcactaattagactgcaaaaaaatcactgatctattagtaatcaaggtaacggaaacgtgatcacaaaatcaaatacagaaatgttcataaaaataacaaaataaaaaacaaaattaaacttttgttttcaagcagaagcactcaactaatatacagaggaaactaactggagactgaagcaataatatttaaaggagagaattggagaggaaatgactcagagggaggtaaaaacagggagccctggtggtttgatttttgctgacaagtactgaaacagcagcaggtaaatatgccgtaacgaagactgttgccaaaagttccagataaacctagattttaaacgaaaggcactgatagtatttaggcttaggaactgtaatactgacttacctcatgataaagatgctatcctacaaatttgaattgagtattgaaaagtcaatttaagttacaaataattttgtttaacgatttcaattttttttcttttttcttttttttttttttttgagacagggtcttgctctgtcatgcaggccttgacctccccaggctcaagtgatcctcccgccttagcctcctgagtagctggaactacaggctctcaccaccaaacccacctaattttttgtattttttttgtagagatgaggtttccccacattccccaggctgttcttgaactcctgggctcaagtgatcctcccgtctcagcctctcaaagtgctggcatcacaggcatgagccactgcacccagccaatgctttcaaatctttagaatgtcgatcacttttttgccaagttatagttttaattttgctatgatgaatcaactttgaagtcaggaagtctgtactctagagcattaagatttgctgatatttgtgtgcatacaggttttggatcccagctgggattttaggttttctctgaaacaagaatgaggcaaggtttctagtgctcctgtttctccattacaaatctacccacaggagagccaaataaatgctgactgacagacaaaagttttagcaggttttcttcctaatttaattcttttctagaaaagattaactcaatcttcaaggttcattcagttaagttttgctccgaagtgtgagaagacaggcaataaacgaattttgtccttaaagggattattataaagactacagttcctataaatttttccacagtggaaccagtagtaactcttgttctattagtctcacaagaccccaagaacactttcatcttattaaactctacacactaaactcctactctctaaatcacatagataatatttactgatcatttatctagtcagaaaaataaataactgttactgggaatgttaaaaaaaaaaaaaaggcaggggccaggggaggctgggcgtggtggctcacgcctgcaatcctagcactttgggaggctgaggagggcggatcacttgaggtcaggagttcaagaccaccctggccaagatggagaaaccctgtctctactaaaaatacaaaaattagcagggtgtggtggtacgtgcctgtaatcccagctactcgggaggctgagggcttgaacctgggaggtggaggttgcagtggtgaactgagattgtgccactgcactccagcctgggtgagagtcggggtgagggggcaggggggagtttggaaagccccagaaacagaaatccataaactctgaggctattaattttagtcaatcaagatttattatgcaaactattgatcagcgattcaactagagcctccaaaattgtttacttagtctataaaactaaaatgatttgttattatttgaaacacaccaaagaacactatgaaaaagttaatcagattgctgtgatagaagggtagtgggaaaaaatgtaattaaagttgggttaaatcaaaacaatttttcagaaatgagttggcaagccactgtttcttgcttttctatgactgcaactggaaagcctggcagaaagaggtgaagtgtcaccatccccacattcacgtatcaagtcaacaagcttctcttttcctatggagttgcctaaagcgttaagcacagcagttaatcatatcctactgtaaattactttaattagataatagatcacttccttctaatacctaaagaaatcacacagagtgggtgagggaaaggtgagttttttcttgtgttttttttttgagacagtatctccctctgttacccatactggagtgtagtggcccaatctctgctcactgcaacttccaccttcggggctcaagtaatcctcccacctcagtctcccaagtagctgggattacaggcatgcaccaccacgcccagctaattatcttattttttgtagagacaggatttcaccatgttgcccaagctggtctaactcctgagctcaagcaatccacccacctcggcctcccaaagtgctgggattacaggcatgagccactgtgccctgccaggtgagttattttgagagcatttttttcttttttttttttttgagacagagtttcgctctcgtcgcccaggctggagtgcaatggtgcaatctcggctcactgcaacctccgtctcccaggttcaagcgattcttgtgcctcagcctcctgagtagctggaactacaggcatgcaccaccacgcccggttaatttttgtatgtttggtagagatggggtttcaccatgttggccaggctggtctcaaactcctgactgcaggtgatccgcccgcttcggcctcccaaagtgctgggattccaggcgtgagccacggcacccggccgagagcattttttaaaagggtgaagtgccacagccggcagttctcatcagccagagcgcagaatgagagtactgaacatggggaaggggcttggtggggtgggtgatgagcaggtgaaagatttgtaaaaaagaaaaggaggggttgagaagggtaatcttactttgaaattctacctggggcgctcaggagacggtctgccgttgaaagtcacctcagcggctggactagattagtaagaatgacaacatcgcatccttcaaaggctctgcctcggctgcactgagacacgataaaggccagtctttaaaaactgagtgatctctaaacactctgcactagtcataccaccaccgtcccgttcaagagtctgtgcctctaaggctgttcattctgtctagttcatgatccctttctcagatggatcaactctgcttatccttgaagacttcaaagaaattagtgagagacagtcaccatcaccagagtcagcacaggtcaacttttctctacaggcttcgggtttctgaagttggacttgatgtggagaagctggatagcaaccaaaatgattgaagggctgtggcgctggcactggtaagaatgaaaagaattagggttactggacttggtgaaaaagacatgaggagaagggacaggcaaataataatcaaacaccatgaatcagagggtagggaaggtagccaccgttcctttgcttttactagagactaagaaatggattatacatagcaagaagcttcagaaaagatttcttactacataaaggttccaagacattggagttgaccaagggagtctgtgaaccctattattttaattactcagctcatggagttgttttgaggattacgtatataaaaatctgcgtaaatgacgtagtatacagtgcctggttcacaccgtggctcaaatgatggttattattattctcttactaagcatgctttaaaggctgtcggaaaactttggggccacctaggaaatcgtagtataatcaaataatgctgaaattcttgtgtgtgtgtgtgtgtgtgtgtgtgtgtgtgtgtgaggtaggggctcactctgtcgcccaggctggagcacagcagggcgattacggttcacctcagcctcgacctcccgggctcagcctcccaagtagctgggaccagaggcgcacgccaccaccctcggctaatttttctatttttttgtagcgacactgcctcgcaatgttgcccaagctgggatgctgaaattcttccccttccaagaatccatctataattatagcctccacgtcattctccctattggaatgtttaattgactaaaactacattgccttcatctgcttactaagcggtggatccagtaaagaccacatcttgtccaaaagacggcagcacttaattagcgctcaaatggcactcgaacgtttgggcgagggggtgttcagtcgcagccaccttactttgcgaaggcacacagggacagacgttcgctaagtgccgatacttagggagaacgagagggcctgaccaggtaaagacggcctccgctgcccaagctacacaaaaaggttggggagccaggacccggcaagcaaggagagaaaagtttcatgcgttgagctggagtctgaagcaaggacctaacggacacagggaaacgtcacaggaaagggagcccaggagagcagacgcggagccaccagaccagaaaaaggaaaaagcactggaaaacagcatcgaagtcaccggaaagcagcatcgaagccaccggcgccagcctcatacctgcgcttcccgctcccctcctcggcgcctagtgataacctcacccgccggcgcccaatcccgtcgagcgtcaggcgtgaggcggcgcagccaaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaaggtgagagagccccgggccacaccgctgcccccagtcccgctccccggcgtcgttcgcggtgtttctcatccgagcttctgagtcagaagcttcgcctcaccagcccgcctttccacggctccagtcagtatcttcctcacctccccccaagataaagattctcttttctttggatcgaagttctgctccttaacccatcccacttccgtgatccacttttcaaacaactaggtagtttgcctcactcattcaacttttgacagttttccccgttaaagacagaccaccactcttgtaccttttaatgccctcatcctacttttctccccggcctccagatagacttcattatattaaataatcccggccaccttaacatgggcttagtttctaagtttctaagtttctagtttgctttcactccacgtttatctcatcttttccaagctctgatttttaaccatttgttttcattattttcccccaagttctctttagttccctccactatattggaggcttacaagtgagtgtagttctagtcatcctgctcacttacaagatacaggcttttatagaacgtccacgggcaccacctaacatactgctttgtcctgctgttattggctgtttccttgctaactttttaatagttccacattgatggtgtctctctttttctatttgtcatctaacgtgctgattacagtttcgctgcatccttcctgcatattccgcccgccttcatatacaaaataaaaatgtcaaggaacaagttgtggtacggctgaaaggactctcaggccgaataaacaaagggtcttggtcttgagttgagttgaatggttaacagctattcagtatagcagtcaatcaagatcatatataagagaagataaagtctgattgcaatgtgttaaacataatgaatgcattagtaactaaaacgataacatccccccctttttttttttttttgagacggagtgcaatggcgtgatctcggctcaccgcaacctccgccttccaggttcaagcaattgtcttgcctcagcctcccgagtagctgggattacaggcatgcgccaccatgcccggctaattttgtatttttagtagagttgtggtttcttcttgttggttaggctggcctcgaactcccgacctcaggtgatccgccctcctcggcctcccagagtgctgggattagaggcgtgagccaccgcgcgataacaccccctttttaatgctagcttgccaacaggggtcggagtaagaagtaaaaatttttttttcatgtgaagcatgtaaaatttatacttatgtagtaaaaccggttttagttatagaagatagggaacattgccattaaatatgtaaactatcaagttgtttctcttttcttttttctttttttttttttttttgagacggagtctcgctctgtcacccaggctggagtgcagtggcgggatctcagctcactgcaacctccgcctcccgggttcacgccattctcctgcctcagcctcctgagtagctgggattacaggcgcccgccaccacgcccggctaattttttgtactttcagtagagacagggtttcaccgtgttaaccagcatggtctcaatctcctgacctcgtgatccgtcgccttggcctcccaaagtgctgggattacaggcgtgagctcatgcgcccggcctcaagttgtttttctattaagcgaaataacaataatttactaggactgtttgtgcgtggtggctattcagtggatactggttgtaatttatataggtgagtacagacgattggaattttgtcctactttgataaatgtgtcggtttcataaattttatttagtttttatttttctgtaaagtttattgtttttacttattttaaactaggagtttttgttgttgtttttgagacaacaaaacaacaaaactctgtcgcccaggctgcagtgcagtggcacaatcatagctcactgcatcctcgacctcctgagctcaagggatcctccttagcttagcctcccgagtagctggcacttcagtcatgtgccaccacactggctaattttttattttttagagacacggggtctcaccttgttgcctaagctggtctcaaactcctggactcaagcgatcttcttgcctcagcctcccaaagtgctggggttacaggcattagccactgcacccagcctaaattaggagttgttgttttgataattgacttgtaatagaaatgttcacatgattcaagattcatattataatatgtaatagataatgtgttcgtgtgagtcaagcttcaatagaagcaaaatgatatcaagcaaaatgttttcctttcatccttgtcgctcagctacccggttcctctccatgtatgcaacctgtcttactttttcttttgtatccttccagagatattttaggtttctgaggtttttaatactttgcttttctgctatgtgcattatagatgttgtagacttgtaccaatcactgttcattcacacattgtaggacttcccttgaatattttgaggataaaagattaattcaaaaggagtcaaatagtctagtaggaaatctttcagtctagtagaggagagaaaaatgtatagaaagaactgctaatgtgtggtagaaattgctccttactgttacagacataaaaaagtatactagaagttcagtgaaaggaggaatttacaaactgagtggaggattggaggagatttgaggttgagcttatatttgagctgaattttaaagatgaggaggagtttagtattttaggaagaggaagtactctgagcagaagcaggacaagaggaaagtaaagggtttgtacaacatatatttttatttaaaaaaatgagtgccaggcactatgctcatttgcagatgcaatggcaaataaaacaaacacagtctcttaatggatgtcttgccttatggagcttacagtctagtaggggaaatggatattaatcaaataatcacacagatgtaaaaccgcatctggtaagtagtatgaaggaaaaatacctagtgctctgattgtcagtagtggaggatttaacctggtggagaggtgagggaaggctttctcagatccatgtactgagacctgaaggatgataagtaggcaaaggggagagagaacagccttccaggagggaaccttatgagtgtgagggatggaaaatatgtcaatgtggctggagcacagagagcaaaggtgatgctggtttgagataagatggaagaagtggactgggaccaaagcgtagggaagccattttgagttgtaagcaagaaggatttgaggtgtggggattggtgatatgattattttgcattttaagagattatttctgactttagtatggagaactaaattgttggttggaagaggaccttagaaatatggtagatcaattaggaaataggtagtggaggagatagaaatgggcagatttagtaagtaaaatctatagaattggcaatagatttgaaatagggatgaggaagagggaagtggtaaggatgactcctagtatttggctcacataatgtagagatcagttgatctagattttttttttgagatgaggtcttgctctgttgccctggctggagtgcagtggaatgatcatagctcactgcagccttgaactcctgggctcaagcgatcctcccacttcagccttctgtgtggctgggactacaggcatgtgccaccatgcccagctaatttttattattatttttttttgtagagatgtctcattatgttgcccaggctggtgggctaggtttcgaagaaatggcagtgagttcagttttgggagagcagcatttacagtatttttgagacagagatttccaataggcagctgttggaggttggagcttagaggagagatctgcgctaaagatataaaataatatagttagattgaatgaaaggaagtagtgggaaatattataaagctatattatgggactagatatatcatggagggctttgaaatatagccttcagtctatagtttgggttttgtactacagttgtaaaccatagaagtttgaacagcagagtgacaaaggctctacttcaaaaagactaggccatagatgagttggagagggcagcggttagtgcctataccagagatacttaagactggaacaggtacatcgaggagagaaggggatggctggagagctgtcgtagaaaacaatatacataggtagacagctgactgggtgaatgggatgaggaagatggatgtgtcaaatggattttcccaggagcctggataacagagaatgataggaaaaggtttagggatagcatagaacaggaaagtggagtttattaatctgttcagttgttttttttttaagttcatattttacatatcaccccgtagcattaattatttaagtcatacttggcatctgatgagaattctctaaagttcagacttagattttaagctaggtcttcatgctgcttttgccataacaaaattcaggttgtgcatgggaatgtgaggctatgggttgtttttaatttattaatttggtctttattttcctttttttttttttttttgagacagagtcttgctctgttgcccaggctggagcgcagtggcacaatttcagctcactgcaacctctgcttcctgggttcaagtgattctgcctcagcctcccaagtagcttggattacaggagcctgccactacgtccagctaatttttgtatttttagtagagacaggctttcaccatgttggccaggacggtctcgatttcttgacctcgtgatccgcctgcctcggcctcctgaagtgctgggattataggtgtgagccaccatgcccggcctattttcccatttcatatgaagtttccagtatctgtttctaaaaagtaaagacacttaatgtaatcacaatatggttatcacatctaaatataaatgtacattaattccttaatatcaaaaatgcagtgttcaaattgccagttgtctcataaatgttaaatgttgcattttaaagttatattttatataatcaagatctatataagggtcccatggcaaaggttgatatgtctcttaaggctattttagtctacatattcactcaccatctccccaacctcccaccttatttgttgaggaaacaaggtggtttactctcagctcgattttgcggatttcattatcatcgtgttgcttgacatgttcttctgtcctctatttcctactgaggtgtgatcaatttagattagattagattttttttgcaagttattttgtactagactcagtggttaaaagtgtgttagaaaataagagctgctaaattgttacgtggcacagaaagtggtgggcaagcacccggcagagagagacatcaagggaattgggtggccctggttaagaatagcttaatagaggtgatcttagagaatgtgtgggagaagaaagcacatataatactttcagcaagaagaacatcatcaaggtagaaagggaaataggaagaatcagatttggagggctgtgaaagccaggcagaagaatttgcagttggtgatgctactaagtatggaactaccagaggttatagaactgggatgagatatgtagtaaaggtgctgttttagaaagacaggtttggaaataattcagatagagagttgaggactgagtttggagaatttggttggggcagaggaagggtggtcaccaaaaaaggaaatgatacaggatcagttcagggaaataggaagatgtcatagaagtttgaggaagagagggccgggcgtggtggctcacgcctgtaatcccagcacttgcggaggccaaggcaggcggatcacctgaggtcaggagtttgagaccagcctggccaacatggtgaaaccctgtctctattcaaaattcaaaaattagccgggtgtggtggtgcacgtctgtaatcccagctactcgggggaggctgagacaggagaatcgcttgaacccaggaggcagaggttgcagtgagctgagattgagccactgcactccagcttgggtgacagagtgagactctgtctcaaaaaaaaaaaaaaagaaaaggaagtttaaggaagaggttgtcaatagtgtcaatgtgaaattggaatttataagaattggggagtaggcatagggaaatattaattaaatattttatagtgaattattgatattattctcttgagttatttagacagtatttgctattttggggacatgttccttccccatttaatcttcttttcctttcttttctttgtttctttttttttttttgagacagggtctcactttgtcacccaggctggagtgcagtggtgtgattttggctcactgcatcctctgcctcctgggctcaagcattccttctgcctcagcctcccaagtagctgggattacaagcgtgcactgccacgcccagctaattttttgtatttttactagagttggggtttcgccatgttgcccaggctagtcttgaactccgagttcaggcgatttgcccaccttgccttcccaaagtgctgggattgcaggggtgagccaccgcgcccggccccttcattgaatcttacgttttggtcttataagtgccttaaagtattttataatacgagcagataggaaaaacattgggaatgcctcagttttattgtgaatgcatgggatactggaaacaaatagttctctgtttttaaatctgcgctctgcagctcactgaaacggtagagtgccagcgaatggtaaacgaacaggtggtgaggggactggatccttgatctctctttgggcctcttgcactaactcgcggttgaaatccctgagaaggactaggtgacctttaagggtcttcctaaatgctgacattctatgcctctggagttgatttttctcaggttagctgaagcataggtcccagccttccactgctttgggtagtttgactaaagtagagaagggattttttaaaaacatactagccaggcaggcgtagtgactcgaacctgtaaccccagctactcggaagactgagatgggagtatcacttgagccaaggagttcaaggctgcagtgcgctacgattgtgccactgcactgcagtctgggtgacagagtgagacgttgtctaaaaaaaatttaaaatacacaaactaaaagtttaaaattgtttatgagaaattgttattgtttgtatagaagagctattttcataccctctttattttggaagtgtaaacctttgtatttactgaagagtcaactaacttgtcttattgatagcttctcttcataaattctagtagttgaacctagatgctatctaagggattatttgatttggtaaaatgagattggtgatttttttattgtgtaagtcatatccagcaagtaggctgaggatctaaggtagtttgtgtttactaaaatttttcataaactttagagctgctaggattaaagtttctgttttatgtaaaatataattctttttgatgacagcattgcccatatgaaaactgtacatctcaactttttggtataaaaatatcaaatataaacaaaagtagagaaaatagtttgatgaacttccttatacccatcaccaagctttgccaatgattaatttatggccagtctagtttcatgtttctattgcacactctcccactccatctctggatatttcaaagcaattcccagataccattattttatccataaacgtttcagtattatctgtaagatataaggatttttcttttttgtatcttttgatgttttaagaagtctgtttgaggaaatactacaatttaaaattttggtcagtgatgaaacggttggcatttattttttaatgttatttattctgttagtattccatcctgaaacttcagccattatttggaaatacttgtgttattttaaaatatataacttcgttatttaaaaacatacagcgtgaagtttgggtaatttttaatatttaagaaaaataaaattgttatttatttggtctgtttttcatctttttagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcaggtgagaaactggggtttttctcaagtatgggcctttgtcaaatcacgccttaatttgttttaaatttacaaatttttatatagcagtttttgtctttttggtaatttttatttttattatttttttattttttcagatacccagacttcaaggagattttttttttttaatgttagggggttatagttaattttgttgggtgttatattttgattttggctatgcagaaaaatattctttttttttttttagacagaatctcactccgttgcccaggctagagtgcagtggcgccaactcggctcactgcaacctgcacctcccaggttcaagcaattctctgcctcagcctcagtagttgggattacaggcgcccaccaccatgcctggctaatttttgtatttttagtagagacagggtttcaccatcttggccaggctggtcttgaactcctaacctcgtgattcacctgccttggcctcccaaagtgctgggattacaggcgtgagccaccatgcccagcctcaaggagattttttgaccatttttaaataaatgtataaatgatctatctcaatatttgtttcctaatacaactttaagcagcctatttttgctccagatcaggggttggcaaactttttgtaagggccacgtagtaaatctttaagtctttgcagtccatatggtctctgtcacaactttttttttttaatgtcattttcaaggtaaggatctatcacgagtttcaactctatttatagtacaaaagcagtcatcgataatacgtaaatgaacgaacatggctgtattccatagaccttatttatgggctgcaggacagatttggtccaggggctgtagtttgccagttcatgctctatatcaagcttgtccaacccacagcctgcatgcagcccaagatggctttgattgtgacccaatgcaaattcataaactttcttaaaacattatgagatttttttgcaatttttttttttaaagctgattagctatctttagtgttagtgtattttatgtgtggcccaaaacaattcttccagtgtggcccagggaagccaaaggattgaatacccctgctctagatggtcatctttcctgtatcacggcacatccaaatctttttctaggctccttaccccagtaaatacagctctgtgcatgcacatgtttgtggattcaaagcccctggaggcatcagtgagttctgcagagacaggcaaattcaggcaaactgctgtattttttattcttttcatcttaggcttaaggcatactcatttgactcaagttaaaattatagttcctatttgtaaaagccgtatttattactacagacttaacagggtgtaatatacaataatctgataagaaattggaagtctttaaagaactatagattgcatatttcagagccacctgtggcgtgaaagttccagcctcagtaatgacctcaagtcaggcatactaaagcagaagaaccaaaaatacatcccattttctgaggtataaaagctggaaggatttttttcatggaatgtttcctcactatccttttaggctctgcggatactataaggagaagggtgtgtagactttatcactaaaaacgaagtcctgtcgccacccttgtaatgattttgtaagtgaaagtccttaagtctgtttttcagagaacatgctctatggttttagtccttttaaatttattgagatttgttttattctaatatgtggtctgtctggatgagtgtcccatgtgtgcttgaaaaaatgtatattcttttgctgaatggaatattctgtaaatgagaattaggcaaagtcgattgataatgttcaagtcttacatagtgttactgatttttttctacccttctattatttactaagaggagtattgaaatctccatctatccttgctaatttgtctttcttcttttagttctctcagtgtttgcttcatgtattttggagctctgttactactggtgcatatacatttctaattgttttatctccctgcctgatttattcttttattatgaaatgacttcctttgactctagtaatcctctgtcaatctgtctttgtatttaaagtggagctcctacacagcacatagttggatcttgatttttatctaacccagtctctgtctctgactttttttttttgagacggagttttactcttgttgcccaggctggaagtgcaatggcgcaatctcggctcaccgcaacctccacctcccaggttcaagtgattctcctgcctcagcctcccgagtagctgggattagaggcatgcgcctctaaaccacgcccggctaatttaattttatatttttttagtagagaaggggtttcttttttttttttttctccttttgagacagagtttcactcttgttgcccatgctggagtgcaatggcatgatctcagctcaccgcaacctctgcctcccgggtcccggttcaagcagttctcctacctcagcctcttgggtagctgggattacaggcatgcgccaccacacccagctaatttttgtatttttagtagagacggggtttcaccacgttggccaggctggtctcgaactcctgacctcgtgatccgcctgcctcagcctcccaaagtgctcggattacaggcatgagccaccatgcctggcgagacggggtttctccatgttggtcaggctggtctcgaactcccaacctcaagtgatccacctgccttggcctcccagttgctgggattacaggttgtgagccactgcgcccagcttcggtctctgacttttaagtgtttagttcatttacctttaatgtaagtgttggattgcttgatgttgtccttatctctgcctctaaaactatgttcttgttttttcccccaaccttgtttctctctaatctttgcattagataatttcttttcctttttttttttgagatagggtctcgctctgacacctcggctggagtggtgcagtggtgcagtggcgtgatgatcttggctcactgaaacctctgcctcccaggctcaagtgatcatcccacctcagcctccagagtagctgggactacaggtgctccccaccaatgcctggctaatatttgtattttttgtagagacagggttttgccattttgcccaggctggtttcaaactcctgagctcaagcagctgcctgcctcagtctcccaaagtgctgggattataggcatgaaccactgggcttgacctaaattagataatttctgttctgtcttcaaggttataaatttttttcttttgccatctcacctctgctattgaactgggctagtaaattttgcttattgtacacttcagctttagaatttccttttttttctttttccttttttttttttttttttttttttttttgagacagtctcactctgtcgtcaggctggagtgcagtggcacgatctgggctcactgcagccaccgactcccgggttcaagtgattcttctgcctcagcctcctgagtagctgggactacaggtgtgtgccaccatgcccagctaatttttgtatttttagtagagatgaggtttcaccatgttggccaggatggtctcgatctcttgacctcgtgatccgcccgcctcggcctcccaaagtgaaagtactgggattacaggcgtgagccaccacactgggcctggttcttttttagagtaaatttccttttcgagattccttatttatttacttatactatatttgtaaaaaaatctttggacatattcataacagctgctttgaagtctttaccaaatccaacacttaggaccacttggattcagcttctgttgattgcttttttcccctaaatatgaatcacgctttcctgtttcttttcatatctagtaatttttttaactgaaacctagatgtgtagataatatgtagtagtaactcctgaatgttttgtttctagaaactgctttattctctgaaaagtataggttttcttgttttagtaggcagttaacttgcctatactcaaactataaactctgtctcatgtgatgtgtggcagctaatgtctgctcagttttttcagctttgctgcttttttagtcctggaggtttaccctgtgcctttgtaatatagtggtcactcagggatttgggaagttaattctcagattttggggttcatcctttctgtggttctgttgcttctggagttcctcctctaagtttccagttgctctgccatctccccacgttttaccccagcacctaaagatggtaagacttcgctttctccaccctgggctttgtgcgtgctgtgtgctcaaaggtgaagcagatttgcagatttcaccaggagtaatcgttacttagtttcaacttctgtaaaatagggatagttcctaggattagtgtgaggattaaatgggataatacaaatacgacacaacacaaatacccaacaaaattagcttttcatttctactttgttaatattttgttggtaggagtggtggtgatgatgatttggaggttcttagatccataaaatgaggtgtgggttaatctgtgaggtgggcaaagggaggaaaaaagcagatgttggcagttactgttaacaggaaatacagtgaaggaaagtaaatgacaatagtaggggttataatcaggtagaattaaattttgattgcaaacattaggactttctgtttccaattttgtagatgcaacatctttttataaaggcaaactaaaaagatgaaacatcctttttttttttttgcttacttttccaaatgggaaaaaactggatatattctgcttccagtttcgtttaataatcagtgctgctgttttttataacaaacaggtgtttcagagttgtgaaccacaaattgtttaataagcctattctatattctacattagaatttgtagccagattggattattcatgattccacattacatgtggaactgctttgtaaactttaaaagctgtgtgtcttactaaggtgatttttaaaattgtggtgaaacatacatatttattattttaaccatttgtaagtatacaattcagtggcattaaatacattcacacacctctctctatacccaaaactttttcctcaccccaacataatctctattatgttcattccctatttccttcactccccacccctggtaaactctgctctacaactatatatatttgagtattctagatactttatataggtggaatcataccatttagccttttgtgtctggctcatttcacttagcataatattttcagggtctatctatgttgtagcatatatcaaaatttcatttctgtttatggctgaataatattccattgtacggccgggcgcgatggctcatgcctgtaatcccagcactttgggaggctgaggcaggtggatcacgaggtcaggagatggagaccatcctggctaacacggtgaaacccgtctctactaaaaatacaaaaaattagccgggcgtggtggcgggcacctgtagtcccagctactggggaggctgaggcaggagaatggcatgaacccgggaggcggagcttgcagtgagctgagattgcaccactgcactccagcctgggcgacagagcaagactccgtctcaaaaaaaaaaaaaaaaaaagttccgttgtatgtatagtatagtaatttgagaagctgatttagattgctctttttggtaaaatatgccaagttatagattttagtgttaaccttaagaaaaacctttaaacaaagagtaaataaaatcaatctaggtagtgttcaggtggaacatttaaattgtaagtaattaagtgtagattccatgtgagtcttaaaaacaaaactatcaaagtaagcatttgtgatgtgttacctaggctggagtgcagtgggcagtggtgcgataccagctttgcgccaccacacccagctaatttttgtatttttaatagagatgggttttcaccatgttgcccaggctggtcttgaactcctgggctcaagcaatccgcccgcctcagcctcccaaagtgctgggattataggcatgagccactatgcccggccagatgtatgtcctttttttatagatgtttcttcctgactagaaagcttcccttctgatttttctagatagctttcaggataatattcttaatattttcaacttcttgatttgtgtcttgtttcttctagctacacccttggcagattttcttctaaccttttgatatctgtttgcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcctgcctcagcctcccaagtagctgggattacaggtgtatgccactatacccagctttaacttttaaatccccaaactatgtagattgtcatattaatattaatttttttttgttattttgaagaagtgagtaatttgaagagatagaaacttagggagtggtgtgtgtgtttcttttttggagacagagtcacgcaggctggagtgcacgatcttgactcactgcaacctttgccacccaggttcaagcaattctcgtgcctcagcctcccgagtagcatgtgccaccacacctggctaatttttttcttttttcttttagacggagtcttgctctgttgcccaggctggagtgcggtggtgtgatctcagttcactgcaacctttgcctcccgggttcaagtgattctcctgcctcagtctcccgagtagctgggattacaggcacctgccaccatgcctggctaatttttgtatttttaatagagacggggtttcaccatgttggccaggctggtctcgaactcctgaccttgtgatccacccacctcagcctcccaaagtgctgggattacaggcatgagccactgttcccgggcctaatctttgtatttttagtagagggggtttatgccatgttggccaggctggtcttgaactcctggccaacaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaaccacctgtgattgcttacatttaaagacattttttacacattggttagaaagaaaaattggggtgccttaatagccagaggtggtgatggaatttacctataaattccatggctttaataatagaatccacattccccatgtttagaatggaaagtggacagagaacagtaattcactagggtcttatttcccaattgcctctaccgccccccaccccaccctcctgctgacatttgtttgataatgcagttgtttgccaagaattatgagagacaggcatgctattcctgaactggctgaatacacggctcctgtgatccaaaagcttaaaagagaatcagttgatgatgttgctaaacaagttggctgatatgttaaagttcaaagcattttaattttttttttttttttttttttttttttttttttttttttttttttgagacaaagtcttgctctgtcacccaggctggagagcagttgatgtgctctcggctcattgcaacccctgcctcaggtgatccgtgtgcctcggcctcccaaagtgctgggattacaggcatgagccaccgtgcccagcccaaagcatttaaattttataaaagaaaaataggtgtaaatgttctgtatttgccgctttgtttagtggaaagagacgccagagacagctttaccagtctgttgtcctgatttcttttttggatcctccctcgaactgtttgcttcttatttaatgtgttcactaaaatactgttgagagcaacatgttctctagtcttcagaataatagtttgctgaaagaagtagccctttaagatttaagattgttattcagcttttgtatgtaggatttcatgatgagtggctcaagaagtaggaatcatttggggagtttccttaggtcaccctgttgatagtgtttaatttctgtttaaggcaggaaaacattaagaaaagattagagaagtcaagtcctgtctatgatatgatatgatacttgtacaccatgttatatttctgccccctttcctgtataaataaaatggggataaaatcaagtaatggttttgaggtcatagctcccttaagaaagtctccctgaaataatgtattaaaattctagcgtctcaagttagattcattagaggcatattgtagtgggaacagaccagatatctttgtttattttaatatagctaacttgttcatattcccaacccatgtttaaagagcatatgattgatctgtgcccccttgttggtcatcttcaccttggaaggaaaggaggcttaaggttgcaatgagagttgttgatgacatctctaacccctcagtaggccaaagagtgatgtagttcatgatccaattgcccagaatagcacggacagatggttactttgctaaaagacatgttggtagcaaagacactgctctgagcagagactggtggcaaagcccagcgcaatccacccttctgagcacagcctacaggaacttcagtgccgacggagtcacggaggccactctaggttttacatggccatagttgagcttctgaaattttgaaggatctccctgcccacccagctactagtcatccacttggtaatgtagacagaatgaaaaaggcaggaaagatcattcatcaaattattttctaacatccgttatctagcaggcttttaccaggtactagagatggaaagatgagaaggaaaaatcgaagttgctgacaagcttctgtgaaagcaaatgtggaaacagactactgtgaaactgaggtaactgctttaacgaaattacaggtgaggtccagggtggcataggagagggaatagttaacctggggcgatgtttaagctgagcttagaagatagtaggtgggagctaatgaggataaatccactgttccaggcaagtgggataggacgtgctatgatacggaggcacagataggtccgctatgtctggaaccatgctggacaagtggtgggggagggcatggaacagggaaattgcgtctggattataattgccataccaaatagtttgggttttgtctattttttcatgggggaagccattcaaaagttttcagcaggggcatgattagctacaaaaaccaatatctgaaaggtgggagtcaggaggtctaggcagaaaatgatgaggacctaaactaaggtgactaaagatggaggagggatgtatttaagagaatgcaggaacacatgtggacaccatttgtatgtcaagagtgagaagctttttggtgcagacatttataaggtactgcttattaagaaagggtattgaaaaggaggaatagattgggaggtgaggggccgagcgcagtggctcacatctgtcatcccagcactttgggaggctgaggtgggcagatcacctgaggccaggagttcgagaccagcctggccaacgtggtgaaaccccgcctctactaaaaatacaaaaattagtcggttgtggtggcaggtgcctgtaatcccagctactcgggaggctgaggcaggagaatggcgggaacccaggaggcggagcttgcagtgagccgagatcgcgccattgcactccagcctgggtgacagagcgagactctgtctcaaaaaaaaagattggggggtgagggtaacgagtgcggttttgaacatgttaaatcggaggtggaaatacagaaaaggcagttggaactagtgagcctggagttaaggagatcggcagccagctggatgagagagctgctggtgtgccgcgttcctcactggccgtacgggctccacagcccagcgggtagagcgagggaggcgggcctgcaatacccccaaaggacaaccaactgccttctaaaccgtgactctgccaactaaaggctgcgggggtgttttgttgtttcgggatttttcttttccttacataccccacacctctgaataacaatcctagcagttcaattttttttttttttcttggagacagagtctcgctctgtcgcccaggctggagtgcggtggtgtgatctcggctcactgcaacctccgcctcccgggttccagccattctcctgcctcagcctcccgagtagctgggattacaggcgcccgccaccacgcccggctaatttttgtatttttaggagagatggagtttcaccgtgttagccaggatggtcttgatctcttgacctcgtgatctgcccgcctcggcctcccaaagtgctgggattacaggcgtgagccaccgcgcccagcctcagttcaaaatttttaggtgcctctttttaattttgggagaagctcagcaatgttctatcattttggtcttgaggcaagaccactggatcaacagcacaggactcatgcggtctaagtcctgggggcgctgctggtcacgacgcgattccggagcagatgtcttccttcctggggctgttgctgaggctgacctagctcaatgcttctcattttgggatgcccactagaatcacctggggagttttttatttctttaaattagctttattgagataataactgacatcaaacaagctatacctatttaccagtgcacaatttgataagctttgatgtatgtatatatccatcacaatcaagatagcctatatgtgggaagcttttaaaagataagatgcagccgggcgcggtggctcacgcctgtaatcccagcactttgggaggccgaggcaggcggatcacctgaggtcgggagttcgagaccagcctgaccagcatggagaaaccccgtctctactaaaaatacaaaaattagccgggtgtggtggcgcgtgcctgttatcccagctactcgggagactgaggcaggagaatcatttgaactcgggagggggaggttgcagtgagctgagatccagccattgcactccagcctgggcaacaagagcaaaactccttctcaaataaataaataagatgccctagcaaattaaattccatggagtagtagagtggagttttgtttgtttgtttttgttgttggttttttttgagacagagtctcactctctcccaggctggagtgcagtggcccgatctcggctcactgcaagctccgcctcccgagttcacgccattctcctgcctcagcctcccaagtagctgggactacaggcgcccgccaccacgcccagctaattttttgcatttttaatagagacggggtttcaccgtgttaaccaggatggtctcaatctcctcatctcgtgatccacccccctcggcctcccaaagtgctgggattacaggtgtgagccaacgcacccagccttttgtttgtttttaagtctccaggtacttctcccctgaactaggagaccaccattcaggaatgacatttgagcagcctcaagtggaggcaaaaatctctggtttattttatgttacgatttgattattttattttattttatttattttattttttgagacggagtctcactctgttgcctaggctggaatacagtggcgcgatcttggctcactggaacctttgcctcctggctgcaagcgactctcctgcctcagcctcttgagtagctgggattacaggcaagtgccaccatgcccagctaaattttgtatttttagtagagacggggtttcaccatgttggtcaggctggtctcgaactcctgaccttgtgatccacccgcctgggcctcccaaagtgcagggattacagacgtgagccaccgtgccaggcaaaaatctctggtttataaccaggaaaattgtatgagaaaaaagagctctagctctagagaccaagagcaaggtgatggcagtgccagagtgagcacctaaggcaagactgtctcttctgtgggtctttctatggcccttagtgagctaaagtgaggctgtcatttaaaagaggttctagcccgggtgcggtggctcacgcctgccatcccagcactttgggaggccaaggcggacagattatgagatcaggagttcaagatcaggctggcgaacatggtgaaaccccagctctactaataatacaaaaattagctgggtgtggtggtgggtgcctgtaatcccagctactcgggaggctgaggcaggagaatcgcttgaacccaggaggcagaggttgcagtgagtcaagatggtgccactgcactccagcctgggccacacagtgagactccgtctcaggaaaaaaaaaaaaaaaaaaaaaaagaggtgtccttatcaggattctttcaggaattagtgctttggtccttcctatatcggagtggcaatgacatttgggtgcctaaccaaagctgagcagctgcacctgtggtttgtcacatcttaaaatcaaacttcttatctctgataaaaggagatataatgattgaaaattgctacaggaaagaaacaataaaacctaatgtcatgggctgagttgcatccccttgaaaatttatatgttgaaatcctccagtaccgcagaatgtgaccttatttgtaaatggggtcatctcagatgttactagttaagatgaggtcataccagaaaagactgggtccctaatttaagataactggtatccttatgaaaaagagatttagacgcagacatgcacacagggaggatcccatgtgaagatgaaggcagcgatcagggccatccagcagatgccaagtgccaaaaactgccagcaaaccaacagaaaccgggcagcggcgcgaagcagattcttccgcaccaccctcagaggaaaccagccctgctgacaccttcatctcagacttctagcctccaggactgtgggacgatacttttttctttttttttttttgagacggagtctcgctctgtcgcccaggctggagtgcagtagtgcaatcttggctcactgcaagctccgcctcccgggttcaagcaattctcctgtcccagcctcctgagtagcgggggttacaggcgcccaccaccatgcccggctaatttttgtatttttagtagagacgcggtttcaccatattggtcaggctcgtcttgaactcctgaccttaggtgatccccctgcctcggcctcccaaagtgctgggattacaggcgggagccactgcgcccggcaagggacgatacatttttgtcgttgaagccaccaactttgtggtactttgctgtggcaaccctaggaaacacaccttttaatttttctctctaccaattctatttctttctggaggcaactttgattttgtgtttggttgttcgccggaaccatgggaaaggccaggaacagttttaaggtgttaaggtttgttggaaggtctttgtcaggttgcattcgtaacccagtgtttgtaaagtacttagtgtagtggttaggggcatggattctggggtcatgaattcaaacccacgttctaccacttactagttctgtgaccctgggtgggacatttgatccctccaagcctcagttcccttatctgtaaaatggggggcggggggaatcgtgctacttactttaaaaggtgatgtgagcattacatgaaacgcacattgagccacttagaacagtgccaggagtgtagtaagtattcactgtatttctcattattattactgaactgttctataataggtaagtatcattaggagccaaccatggaagaaaagcaattttagtcactaaaaaaaaaaaaattgtggtgaaatataaaacattccattcatctggttctaaaattaagaataggaaacattttaaaataggaaatgttttaaaatttaggaaacatttaaaaatattcaaagcaacagaacctgaggtagtacaagcaaaataagtttattttagagatacagggctggctcccagagatcaatagcaggaatgccttgtttttcatgaggaagttggacaaagcaatggaaagccatcaggagcctgggaataccacctcttccttattcccgagacatttcttcattctttccccaaacttcctcttctacatagtccacgttgtgaaaaatggccacccacacttctcccctccatccaagagatcacctcggggtctcagatagactccaattcctactactggtccaatcagctatggccatgggatggggagtgggctcacacggtacctaggatgccactggggtctcagccctacgactctgtggctgggggatgagggggagggaagtcataaagaagagagaatgggtactgcaggaagacactaataaacatgcttcctcccacccccaaagtttggccatatgaggaatagcacatttgaggactccccagaagaaaaacgacaaaggaggctgaaaggagtgaagaggaaaaaagatacagaggggagagcaaggtaaccccatcaagtactggagactcacagcaagacagccacccagagggggagcacagcgtctcggtgtaagactcagggtggtgccttgcccagcctctgccctgagaagcaacagacactacctgcgctgtcaggggctgtgtctgagcaggagctggtttgctaaatcaagggcaagaagagaaagctcaggtcttttgggtcttgaagaaactgtacttcttacctcgtccttctcttctctgttttaagggagagactaaagaatggtgaggtttgaaactcagaggaaaaccagcttggtgatctgttttttgtttagctgacacgaaatcattcacacccagcagctcactgcctgcttattttaagcatgaaaaatgagggtaataagtttctccctctcttgtgggaattatgttcatatctttcactggactcctttcctacacacccagagcttaattttggttacttttggaatactaaaatgaactgagggtcccagcctggaagggagtttggtgatgaggtgaaatgaagtattttagggcaaggatggcaacggaattcaaatcctctgccgtgacacccaagtgaaatgctctgcttctcacagagtgacacttagagctgtgggttttgagacagatagaaagggatctctcttggttttttgtttgttttttgagatggagtttcgctgttgttgcccgggctggagtgcgatggcgcaatctcggctcactgcaacctctgcctcccaggttcaagcgattctcctgcctcagcctcccaagtagctgggattacagatgcccgccaccatgcccagctaattttgtatttttagtagaaacaggctttctccatgttggtcaggctggtctcaaactcccaacctcaggtgatccacacgccttggcttcccgaaatgctgggattacaggcgtgagccactgcgcctggttgaaaaggatctcttgtaggaagatggaacccagaggggcttaagaggacctacgcacccgcaggcctcctctccctgcacaaaaacataggcgtcccctgatttcatgaccagttgtcatgaaatcacacccaagtccctcacttagaaacccccacgatgagttaaactattcactggccgggcgtggtggctcatgcctgtaatcccaacactttgggaggctgagacagttggactacctgaggtcaggagttcgaaaccagcctggccaagatggcaaaaccctgtctctactaaaaatacaaaaattagccgggcatggtggtgggcacctgtaatcccagctactcaggaggctgaggaaggagaatcgcttgaagctgggaggcggaggttgcagtgagccaagatcgcaccactgcactccagcccggccgacagtgagactcagtctcaaaaaacaaaaacaaaaacaaaacaaaacaaaaaaacaccgttgcctgcagcttccctgcccataaagaaacgcatgctatagtgaaggaaagtggcacagccttgtcttctatgcatctgccttccaagaccttatcagaagtggctggtgcacaatttatgattgaggtcttcttacctcttttcccatcataatcatgactagcagcaagaatggaacatgtagagccctagtctaggcaatcaatatagcactcacattcctttgactcagcccctcctccatggaatatgcagcgcgggtactgttagtgtgtctggaattggtgggttcttggtctcactgacttcaagactgaagccgcggaccctcgcggtgagtgttacagctcttaagggcgcgcgtctggagtttgttccttctgatgttcggatgtgttcggagttttttctttctggtgggctgcagactttcgcggtgagtgttacagctcttaaagcggcgcatctggagttgcttgttcctcccgctgggctcgtggtctcactggcttcaggagtgaagctgcagacttttgtggtgagtgttacagctcataaaaagcagcgtggacccagtgagcagcagcaagatttattgcaaaaagccaaagaacagagcttccacacaatggaaggggaccggaacggcttgccgctgctggctcgggcagcctgcttttattctcttatctggccccacccacatcctgttgattggtagagcctagaggcctgttttgacagggcgctgattggtgcgtttacaatccctgagctagatacaaaggttctccacgtccccatcagattagttagatacggagtttccacacacaggttctccaaggccccaccagagcagctagatacagagtgtcgattggtgcactcacaaaccctgagctagacacagggtgctgattggtgtgtttacaaaccttgagctagatacagagtgtggattggtgtgtttacaatccctgagctagacataaaggttctccacgtccccaccagactcaggagcccagctggcttcgcccagtggatcccgcactggggctgcaggtggagctgcctgccagtcctgcgcgtgcgcccgcactcctcagcccttgggtggtcgatgggactgggcatggtggagcagggggtggcgctcgtcggggaggcccgggccgcacaggagcccacggagggggtgggaagctcaggcagggcgggctgcgggtcccgagccctgccgagcgggaaggcagctaaggcccggtgagaaatcgagcacatcgctggtgggctggcactgctgggggacccagtacaccctccgcagccgctggcccgggtgctaagcccctcattgcccggggccagcagggcccgccagctgctccgagtgcggggcccgccaagcccacgcctacccggaattccagctggcccgcaagcgccgcacgcagccccggttcccgctcgcgcctctccctccacacctccctgcaagctgagggagcgggctccggtcttggccagcccagaaaggggctcccacagtgcagtggggggctgaagggctcctcaagtgccgccaaagtggaagcccaggcagaggcgggccgagagcaagcgagggctctgaggactgccagcacgctgtcacctctcattaggactctgcagcgcgggtactgttaggactctgcagcgcgggtactgttaggactgggtccctgcactccaggtcttcagagatgttgtgcttaatatttctgggcacctgctatgtgttttatctacattacttgatttatttattagaatatcttgatggtattcacattcgtggaacactgaggctcacagacgataaataacttgctaaagtcacacaccttaagtttcagagtcttgtttcagcctagatctctgactcaaaactttggttactttctcctcaagggggaggcagacgtgtcgcagataaacatccaataacaagtaagtgctcttgaagagataaacatgagtagtgctggggtggctgacttgcctggagagtcagtagatacattttgactgttgttttatttaccaggactggagaggaaaatgggaagaacatatattctctctcttcacagccagctcctctctgctcctctcctcgcttctgtgaacaattccctcagcctgtgtatgaatcatgatcaccattcactatagaaccctgacctgtgtccgggttgccagacataatacaggatgcctgatgaaatttcagatcaatgaatagttttttagtatacatacatacccaatgttgcatgaaatataatgatactaaagaattattcgtgtttaaaattcaaatttcactgtgggcactgcattttttcccaattttcaaactgtggtactgtacacataatgtaaaatgtttaccatcttaaccaatttcaagtgtacagttagtggtactaaatacattcatgatgtgtgcaaccatcagcaccatccatctccagaactttgtttgtttgcttatttgtttagtagagatggggtcttgctgtgttgcccaggctggtctcctgctccgtgactcaagtgatcctctcgcctcggcctcccaaaggctgggaatacaggcgcaagccaccatgcccggcctctcgagctcttttatcttgtaaaattgaaaccttatgtctactaaacaataactctacattcccccaactccccagtccccggcaaccaccatgctactttgtgtatctgtgattttgactcctctaaacactgcagataagtggaattacacagtatttgcccttttgtgactggcttatttcacttagtgtaatatcctcaaggttcattcatatgttgtaggatgtgtcagaatttttttcctctgtaagactgaagactgttccatcgagccacgttttgcttatccattcattcgttgatggactctgggttgcttccacgctgtagctgctgtgaggaacgctgctgtgaacacgggtgtgcaaaggtctctttgaggctctgctttcggttcttgtgggtctattctcagcagtgggatgctgaatcatacagccattctctgttttatttttcgaggaactgccagactgttttccaggctggctgcacattttacactcccaccagccgtgcacgaggattccatttctccacgtcctcaccaacgcgtctatctgatgttttcgttttcccaaatagccatcctaaagggtgtgaggtgagggcattctttatttgtatttgccaaatgtagcgaccctaaagcccagccagagacctcttgccgggctctgatgtcacaccttgcccatctaacccttgccttttctgtgtcgcatcctggcctggactcctggtcctctggtcctcacccagcctctcctcatttactgctgcccatgcctcagtgtgagactgtgtctggggctctcgtcacctcttcttgccttgctccctctgagagcacctcgctggcaccacactgacaggttggcaccataggctgagcctgaatgtagaaactggcagaacatcaactcaaaggaaatgtcccaagaggagaaaatgttgagacagcaaaagtctgtggcctaatctcagagcactcacagttatagatccctgacactttgcaggccagaagaagctgaatttttagttatttgatcctttccccagttagggttccagcttcctcctcctttccctttttcagatactaagaacccaccatgagcaccacactgacaggccggcatagacaagtaaaactctgccctcaaggatctaggcccagtgaggaagccgagacctttctaaatagttgtaacatatagaaaatgagaacagctgaaggaagtgcaggaggaacgccacatgagggcatttgcgggtgagggagggtccaaggaactttgtggagcaggtgtcatctgagcagaaccttaaaagataaatggtatttaagcatgtatcaatttgccaaataaaattgttaacacaaatttatatttatttatttatttatttggagatggagtctcgctctgtcgcccaggctggagtgcaatggtgtgatcttggctcactggaacctccacctcccaagttcaagcgattatcttgcctcagcctcccaagtagctgggactacaggtgcacaccatcacgcccggctaatttttgtatttttagtagagactggtttcaccatgttagccaggctggtgatctagccataggtgatctacccaccttggcctcccaaagtgctgggattacaggtgtgagccactgcgcctggctgcacaaatttattaatagcaatttaccaatgttgctcgctaaaactttattacttttttttttcttttttttttgagacagagtctcgctctgtcacccaggctggagtgcagtggcacgatctcagctcactctaacctccgcctcccaggttcaaaagatttttgtgcctcagcctcctgagtagctgggattataggcgtgcaccatcaagcctggctaatttttctatttttaggagagacgaggtttcaccatgttggtcaggctggtctcgaactcctgacctcatgatccccctgcctcggcctcccaaagtgctaggattacaggtgtgagccaccacgcctagccaaaactttattccttttagcaatttgtagaatgtatagcaatttaatttttaccaagctttcccaatattccatttatttatttatgttttcatttcaggcaatgtttatgtcccaaatgtcaaaaaacattttaaggttggtttttctcttccaaccatgtttttctggttttaaaagtaatctttatttttaattaatttattaattaaattaatataaattaatgtgatagaaattaggataatttaattactcttagttaatatgtgcattataagaaaccgaaaaacacaagaagcagagaacaaggccgtccacaatcacgagcagtttgcagttgaccgtgtccttccaggtcccgtgtatgtacagacacaacacccagtggatcgtgctttgtcacacaacattctgcccaattttaaatccgttttgctgcctccttgagattctgtgactctagtggcttggttcccacaggtatctccctttgcaaatctatgcttgaaggtttctctgtcatgctaagtcagtgactattatttttcaattctgacatctttgaaatatgcagaagagaccaggcgcggtgctcacgcctgtaatcccagcactttgggaggccgaggtgggcggatcacgagctcaggagatcgagaccatcctggctaacacggtgaaaccccgtctctactaaaagtacaaaaaaattagccgggcgtggtggcgggcgcctgtactcccagctactagggaggctgaggcaggagaacggggtgaacccgggaggcggagcttgcagtgagccgagatcgcgccactgaactccagcctgggtgactgagagagactctgtctcaaaaaaaaaaaaaaaaaaaaaaaagaaatatgcagaagagtaaagagaataacaacaaacacccatctgctcaatgttcagctttagcaaatcttaaccttttgccaaatttgcttcagatatttttttctcagaaacgaaatattacagatacagttgaagcctcttatacatctatgcctgtgatttgactcctttccctctctctccagaacttgacacgtgtcattgctgtgtttgttttcatgcttttctgtagtgtgatgggtccccagccaagttactaaagagtgtgtgtctgctgcctgaaccctgaaggccaggccatgagccaaggccacagtgcccagcagaggagcaggtgtccctcagaaccaagcgtcccggagggtttctaagaaactaccaagaaaaacagtccatcactcacacagtgggcaaagagccagaaaattagcttaaaggcagctcaagagtgtggccgggcacggctcatgcctgtaatcccagcactctgggaggtcaaggtgggtggttcacgaggtcaagagatcgagaccagcctggccaacatggtgaaaccccatctctactaaaaatacaaaaattagctgggcgtggtggcatgagcctgtagtcccagcaactcagaaggctgaggcaggagaatcacttgaatccaggaggcggaggttgcagcgagccaagatcacgccactgcactccagcctggagacagagcaagactccgtctcaaaaaaaaaaaaaaaagagtgggaaaatgggaggcaatgcaggtctctaaagctgtcctgctactgcccaggaggccttgtatgtaggtccaaataaactcatctacttgccaagctggacgtgtctcagtcattctttggtctctcagcctcctcctagtttgggaaaaggttttttgtttgtttgtatttttttaatacaattccaggttttctttgttatgtttctacatatccattgatctataaagaaggcttagcattttttgcatatttctaaaccatatacaggatatatacacatgcgtgtgtgccacgaaccgtttatgtcctcctgcaacttcgtgttcttgtgatttatccattcctaaacatagaactgttacttcttttttaattgctgtacagcagaggtccccaaaccccagcacaggtgcacagcctgttaggaaactgcgtcacacggcaggaggggagcagcaggcgggtgagcaagtgaagcttcatctgtattgacagccgctccccatcactcgcattactgcttgagctccgcctcctgtccgatcagcgccggcactagatactcatagctatgtgaaccctattgtgaactgagcatatgagggatctaggctgcatgctccctatgagaatctaatgcctgatgatccatcagtgtttcccatcatccccagatggaaccgtctagttgcaggaaaacaagtgcagggctccactgattctacattatgctgagttgtataattatttcattatatcttacaacgtaataataatagaaataaagtgcacaataaatgtgatgcacttgaatcatcccaaaccatcccccacccccagtccatgaaaaaatggtcttccaggaaacgggtccctagtgccagaaaggttggggaccgctgccgtacagtattccatttcaccaacatactaccgtctatcaattcttctgttcacgaccatttaggttgtttccaatttgtgattacaaacaaagctggaatgaattctgtatgtatgtgctctagtctctagaatatacattatgagaagcggcattctcaagttctggcttatgctcatctccgcctttgttagatattgcctcattgttcatcaccatcaatatttctgtttatcaagcaagggacgagggcaagcagcaaaaataacacatggtacaggtatgtttcaacctgcaggtgtgaggggatgcatatagtgcccaagattctcaccatttcatggggaagagtgcttaggctaggcatagctggacacatcatgtgttctgtacaagagagggaatataaaattccttgttgtctcacgcatttataaagtattatggagggcaggcgccgtggctcacgcctgtaatcccaacactttgggaggctgaggcaggtggatcacctgaagtcaggagttcaagaccagtctggccaacatggtgaaaccccgtctctactaaaaatacaaaaattattcatgcgtggtggtgggcacctgtaatcccagccactcgggaggctgaggcaggagaactgcttgtacctgggaggcagagctcgcagtgagccgagatcacaccaatgcactccagcctgggcaacagagcaagactctgtctccaaaaaaaaaaaaaagaattatggaggaatcagagatcatctgaccaaggtgtctttgcaattcaggtttcagcctttctggcctaagaaataatgttagaaacaacccaataatccagacagtttatacatgagggggtttgtggccctccctgaagagccagcttattgctaggttacctgaaaaaagactcacaagggtcatccacttaacaaacttgtttatccctctgcattacacctctggccctggcgatttattaaacaggctttccgacccagggcttgtattagttgacaacatcgtgacaagtttgcatcatgggccatgaaaggcataaaaggtattttgaggcttctgtccatatctgtaaaacaaaaggagaaatagtctttaaaacatttttaatataggtttttaatctatctagaatttatttttgttatggagaaagtagaaatttcattattaaatacatactgttaatattgtatcctgctcctatttattgaatagcttatgcttccattgatttacagtgcctcctctgtcacatatcaagtttccatatgtacatatacatgggccagctcctggactgtctgattcttttggcctctttgtctacacataggctagtactatacactcttagttgttctcactttataatcaatcttagggtttttgttttgttttagagtcacggtcttggtctgtcacccaggctgtggtacagtggcatggccatagctcactgtacccttgaactcttgggctcaagaaatcctcccatctcagcctccctagtagctgggacttcaggtgtgcaccatgacacctggtcaatcctttttatagatcttttataatgttttaaataagcttttttctagggctggagtctcactatgttgccaaggctgagctcgtattccagatctcaagtgatcttcctgggatcgtaggctgggattacaggcatgagccctgtgatcacggctcaccgcagcctctgtctcctgggcccaactcctgatcttgaactccttggctcaagtgatcctcccacctcagcctcccaagtagctgggactacatgcacacaccactatgctggctaatttttttgcatttttttgtacagacagggtttcaccacattgcccagggtggtcttgaactcctgggctcacgcaatccgcctgccttggcctcccaaagtgctgggattacaagcataagccagggtgcccagccccagtcttcattttgaaagagcaattccctcaaacttttggttttaaaaaattgttttggttattcttggccctttactcttctatatagattttagaacgtaccttgtgaagtcacctggaagttctgttgggatttttattgaaaattgaaaatataaatcaatatgcatgttgaatcaatagacttgggaagaattggtatctttatgatgaaatgcattctcatccatgactgtagcatatcttcatcatcttttatgtcattcaatattgtctttgaagatccaataaaaagatagggttctctgcttgggtttggcccctgtagaggccaaaatattatctttattgctggtagcgaccaggttagaggacgtagctttaggtctgttagctgagtgtttagtagatcaaggcaacaaatatacaaacaatttgataaacatatatatatatatataaaacaccgccagcagtttgctccccaaaaagaaaagcagaactaacatatccagattattcttcctaaatttactatttaacatcactctgtcctccaaggagcagaatgagtaaagaggcagagagactgagactatcacaccaatagaggtccttgaaatgaatggaaatcttaggagtaggaactaagcatgctttcctcacaggcatctaagttgtttgtgtacagatcctttgcccatttaaaaaatgagtaatttggccgggtggagtggctcatgcctgtaatcctagcactttgggaagtcgaggtgagcagattgcctgagctcaggagttcaagaccagcccgagcaacatgatgaaaccccgtctctactaaaaatatttaaaaaattagctgggcatggtggtacacacttgtaatcccagttacttgggaggctgaggcacaagaattgcttgagcctgggaggcagaggttgcagtgaactgagattgcaccactgcactccagcctgggtgacagattgagactctgtctcaaaaataaaaaataaaataaactaaaataaaaaatgcgtaatttgtctttttattgttgagttgaagtccaatttatttacttcttttgtcacttgggcttttggtttcatatctaagaaaccattgtctagttcaaagtcacaaagatttactcctttgttttcttcaaagggttttacagtttgatctctcacatttaggtctatgagaatttagaattatttttttgtttatggtgtgaggtaggaattcaacttcattctcttacatgtggatattcacatgaactataatctgttcaatcatttctcctttactgttattttcttctgaggcttttaaaaggggatatattagagacccaatgtattgtctcgattgcctagctgatgtcacatattttttacttgaaaaaatgtctttatcgtgtttactgctctgtcttgtgttaattcacaaattttctctttgtgctcagtatggagtttattctattagattttaaaagtcattaaacatatgtcatgttcgtaagatttctaacccatttttttctcatttaaaaataaactaatgaatttactatttttgaatatgaaacataggcacacagcacagaattcaaagaataaaaaatacaatgatgaggttattggctttaaaaatatttacctgttcttgtttcatttttgttagttcttgtttcataactttgttataatgtgtgttatttatagagctataagtgtgtgtgcagggggagttggtagaagacaacataggtcacagcctgtgcaaggaagaatagtgggagacagaaataaagaggtaagttggggtcagtttgtggactttggaataaaagggaagaaaacagttgtcgaagagtatgaagcttattatcttagccatgtagtctttgaataatttttttaccacttaataaacattgtgctttaagaaggctaaaatgcttcagatataccaaagggaggagatgggtagtctaggcctcattaaaaggcttccatctcaggtgggtacccaaccaccttatacttccttgaccccttttcacaggcctgtatgctgattataagccagacgtttcagacattttgtgaaaagattttagtgtctggctatatttaaatgctctgttttatcacttacccttcaaagtcccctcctctcctgcccctgatgtggccactctgaaaggagtccctctccccgggatccaacagtgttctcccagcagggggcagcagcggcacatgtcaggtgcccaggggagggtggggtgccaaggggtgccctgtggggaggagcttgcatgaggaaacacatggaatggaaaaagtaaactagttcctcagtcccacttcagagtcaaacccgcacctgtggtgagttgagccacaaatatgttttctctaaagctggcagccgtttattttggaaggaggaagatgcactcaatactattgaggacctggcttttttttctttgctttttcctaatttcttatcctctgcttcggccataaatgttctagtttctctcactcttctctttcccttccttcatgtccaacattttcccatttttttcccaatggtcaggagtataggtctggccaaataatcaccttctagtaataagaatatttctggaaataagaaacacagcataagggaagggaaaagctggttggctcccccagttcctcacctaccccagaggcatcacactgatctccaagactatcatcacccggaaggcaaaggcctctcacaatttcttacacatctctatgttccccactcacttgctagactggatgagaacatagacacccacctgcaatctggtctatagctttgtccacacccgcatggcatgtggagaaggaatgcctgggggtaggacctggggggctggggatcaaaacactgtaatgaggggtagttttgcagaaatccccaaaaatgtgatcctaggaccttctcactgcttctccctgaaatccactgttacaatgcccttatactatctcggtatctaggtgtaccacagtagaggcagcgtggtaactgtgtgacctctaacctagtcccaccatggccaaggtgacaaacatgtacatgggagtttatcatcttgggcgtggttgaactaggttagaggtcacatagttaattttgggcaagtcacttgccttctctgggcctcagttttcttttcttttttttttctgagacagagtctcactctgttgcccaggctggagtgcagtggcgtgatctcagcttactgcaagctccacctcccgggttcatgccattctcctgcctcagcctcccgagtagctgggactacaggtgcccaccaccatgcccggctaatttttttgtatttctagtagagacggggtttcaccgtgttagccaggatggtctcgatctcctgacctcgtgatctgcccgcctcggcctcccaaagtgctgggattacaggcgtgagccaccacgcccggccctcagttttgttatctataaatgggtattaataatgcctttcataaatatctcacagaggacgggcgcagtggctcatgcctgtaatctcaacactttgggaggccaaggctggaggattgcttgaggccaggagtttgagaccagcctgggcaacaaagtaagaccccatctccacaaaaaataagaattagctgggcatagtggtgcatgcctgtaatcctagctacttgggaggctgaggcaggaggatcccttgagcccagaaggtggaggctgcagtgagctgtgatcgtgccactagactctagtatggtgacagagtggcgccttgtctctaaaatataataaaaataaatacctcacagacgtgagatactcaagtaagataataatgtgaaaagtttgcatttatggtggagtgtttttaaaacattatttatcattactagctctttttcaagagcactttggcccttgtctcatgggcatgttgcttgaatttcagccaaaggattaggtgttgggacaagttggcttaaaaacatcttttaaaatttattttaatttatttttagagatatggtctctctatgttgcccaggctggtcttgaattcctggcctcaagccatcctccttgcctcagcctcccaaagtgctgggattacaggcatgagccaccaggccaggccaaaaatttcttatctttaattattacggatacataatagttgtacgtctttcaaattgaactcttgaggggtccagggccattgagaggaaagacagcacagaaccaggtggatttatttctagggatttggctcctagccccttgtcagggaaggtggcttctttctttccctggggccaagagagactaatagggagatgtatctctagaatcctaggtctgaatgagacgccaatgggtcattggttttaggtgtttttttgtttttgtttttgcccctcaggtaaggctacatcgaaaccacactaagaggatcagaaagaatatatgttaaatgtttccaaggagattctatattctttccaggtaattcaggactaaggatgttttacagcgagttcttctttttagccttttggctgcaattgagggttgaaaatgctttgagggtagtctattcatctttatatcctgtccaaacccagcacaaacaggccctagggtcccgtctattgacctgaactgcattgttctgctctgcctggagctaggaaatatgctggtcactattttttgttggctttaaatatagtatttgcaaagttcaaaacaaatcttatgatcatttggcttgtggcttctctcctaaatctccctccttttagaatggtcaggatgggaggaggacgtgccaagactgagcttctgtttcttttcaaggacagtccctgcaatggcttcgtttgacctaccctcccttttcttatcaaatgaaatcagctaccacaggaaattgacttctccagattgtaggagacaggaagcagcaccacaaagcaggttccagggagggaaggcagagatgagagaaacagctcgagtcccagctcggtcagtgcctggccccggcctcgctttccgcctctctgtctcattcttaccatctctagcctcacctacccttcttctgggtcctggtgtctgaggctgaaaggcgctgtagaagtctccaaggccagcctccctccccactcagtcactcccaacaagccttccagcctgtgcttgacccttccaggcatggaaattttactgcttcccctaagaaaccagctctgttttgccttttatccatctgaaacctccctcctccagtgttcttccactggcctcacttttccttgggacagccctttccatacctgagtctccaggctaagccctcccggggaggtctcttggtagaggcatgagtttctcagaaactcaaccagagggagtcaggaaggggtctaagcaggaaggaaaaggtgagaacaatgccatcgtgggccctttccttgccaaggagttatgtgtggtggctttaacttgatgtttagtacaacttcaacgtgcttttcttctcctgcatgactactgccttgtgggaagagtgtcttctcttttagctcacttcattaattttttatgaaatatctaaatacatatataaaggtgtcatgacattccactcctaaatacttcagtgtgtatctttaagacgtaagaatattggccgggagcggtgactcatgtctgtaatcccagcactttgggaggccaaggtgggtggatcacctgaggtcaggaattcaagactagcctggccaacacggtgaaactccatctctactaaaaatacaaaaattagccaggcgtggtggtgggtgactccaatcctagctattccagaggctgagacatgagaatcacttgaacccgggaggcggaggttgcagtgagccgagatcacaccattgcactccagtgtgggtgacaaagcgagactttgtctcaaaaaaaaaaaaaaaaaaaaaaaaaaaaaagaatatgttctgcatagccaaaatcaaaatataacacccaacaaaattaactataacctcccgacattatttaatacttaatccacaaaatttccccagttgattccaaaatgtcctttactgctgttttgttcaaaccaggatccaatccaggaccacgcatttcatctggttgttatggaacttagggctcttttatggatgatgctgataaatagaaggaagcttcattgttaaagtgctctctttttaaaaattcatatcagggccaggtgcagtggctcacgcctgtaatcccagcactttgggaggccgaggcaggcggatcacccgaggtcaagaattcaagaccagcctgggcaatgtggtaaaaccctgtcttgactaaaaatgcaaaaattagccgagcatggtggtacacacttgtaatcccagctacttgagagactgaggcaggagaatggcttgaacccaggaggcggaggttgcggtgagctgagaccacgccgctgttctctagcctgggcaacagagtgagactccatctcaaaataaaataacataaaataagtaatcaggctgggcacagtggctcactcctgcaatcccagcactttgggaggctgagggggcagatcgcttgaggccaggagtttgagaccatcctgggcaacctcgtctcctcaaaaaatacaaaaattagctgggcgaggtggcgcatgcctgtggtcccagctactcgagaggctgaggtgggaggatcctttgagtccaggaggcagtggtttcagcaagccgagatcatgccactgcactctagcctgcgccacagaaccaaaccgtctaaaaaagaaagaaagaaaaaagaaaaaccaaacaaaatacatatcatatatcatcaacatagttcattacgccattattatatcatcagtatagttcacattacacatcacatgacagtggtaccactcagacgccatgaaccttctacttgagacagttaaattcaagaataatttttttggccgggtgcggtggctcatgtctgtaatcccagcactttgggaggctgaggtgggcggagcacctaaggtcaggagttcgagaccagcctggccaacatggtcaaaccccatctctactaaaaatacaaaaattagctgggtgtggtagccggcgcctataatcccagctacttgggaggctgaggcaggagaattgcttgagcccagaaggcagaggtggcaatgagccgagatcatgccactacactccaacctgggcaacagagcaagactccatctcaaaaaaataagattaaaaaaaaaaggataaattttacaagactccatctcaaaaaaaaaaaattttttttttttttttttttgagatggagtctggctctgtcacccaggctggagtgctgtggtgcaatcttggctcactgcaacctctacctcccaggcttaaatgtttctcctgcctcagcttcccaagtagctgggactacaggcgcatgctaccacatccagctaattttcgtatttttagtagggacggggattcaccatattgggcaggctggtctcaaactcctgaccttatgatccgcctgccttggcctcccaaagtgctgggattacaggtgtgagccatagtgcccaagaataatttttttcaagaagtattcagtctatagagtcccagtaacagaggtaataaacatacacatggtagtatttcaaattcatgaatttgttcagcttgggagcaatgggaatttagctttttcttttatcttttttttttttgagatggagtcttgctctgttgcccaggctggagtgcaatggcacaatctcggctcactgcaacctctgcctcctgggttcaagcagttctcctgcctcagcctcccgagtagctgggattacaggagcccgccatcacacctggctaattttcgtatttttagtagagatggggtttcaccatgttggtcaggctggtctcagactcctgacctctagtgatctgcccaccttggcctcccagagtgctgggattacaggcgtgagccaccgtgcccagcctagagctttttcatgtttatttatttatttatttatttatttatttatttattttcagaataacctgaaatttattctagttatattggaaaaaagaaaatcctcaatcactatccacatcatacaacataccaattctgactcaaatgccgacctacatttttttttttagactgatggggtatatgcgcatgtttgttacatggttttttgtttgtttgtttgtttttgttttttttcttttttttgagacagagtcttgctctgttgcccagggtggagtgcagtagcacgatctcagctcactggaacctctgcctcctgggttcaagtgattctcctgcctcagcctcctaagtagctgggactacaggcacccgccaccacgcctggctaatttttgtatttttttagtaaagtcagggtttcatcatgttggtcaggctggtcttgaactactgacctcaagtgatcctcccaccttggcctcccagagtgctgggattccaggtgtgggccaccgcacctggccacatgggttatatcgcattatggtgaggactgggcttctggtgtacccatcacccaatagtgcacattgtacctaataggtaattttttgcccctcatccctcccaccctccccccttctggagtccattccatcttcatgtccatgtgtgcccattgtttagttcccacttagaagtaagaacatgcagtattggagtttctgtttctgagttagttcacctaggataatggcctccagctccacctatgttgctgcaaaggacataatttcattttttttttttttttgagacagagtcttacgctgccacctagactgaagtgaagtgatgcgatctcaactcactgcaacctccgtctccctggttcaagcgattctcctgcctcagcctcctgagtagctgggattacaggtgcgcgccaccatgcccggctaatttttgtattttcaggtgagacggggtttcgccatgttggccaggctggtctcacactgctggcctcaagtggtccacctgcctcaggctcctaaagtgctgggattacagacgtgagccaccgcgcccggccacatttcgttcatttttatggctgcagttacagtgttctagctggttcttctgtgtcctttatttcctataaatgatcaatgagatgttaacatttgatttaattcaagttagacacttttagcaaggatatatcctaagtgctgctgggtgcttcgtgcgcaccatggtggaagacatattctggttgttctcccatcagtgatgctaatattaacccctgcattagtgctaacagtgtgaccctctgattgtgaccccttgattgtgacccctttattgtgactcctttattgtgtttcttttcctctcttgtgaccaaagagaagtctgcatggttgctgttgcatcacacaaatgtcaggtgatgtttattttattttatttattttttttgagacggagttttgctcttgttgcccgggctggagtgcagtggcgcaatctcggctcactgcaacctccgcctccttggttcaagcaattctcctgcctaagcctcccaagtagctgggatgacaggcatgcaccaccacgcctggctaatttttttttttttttttttttttggatttttagtagagatggggtttctccatgttggtcaggctggtctcgaactcccaacctcaagtgatctgcctgcctcggcctcccaaagtgctggaattacaggcgtgagtcaccgcactcagccaagtgatgtttatttaaaagtcacaattggtcagaaaaagaaaaggcagatatgttaggattctcaaggacatatatacagagaaagagatatttttaaggaattggttcacatagattatggaggtgggctagtccaaaatctgcagcgtgagctagcaggctggagaacttcctcttcctccagggagcagtctttttgtttcaggccttcagcagactggatgaggcccactcgcattatggagggtaatctgctttgcttaaagtccactgatttaaatgttaatcttatccaaaaatatcctcacaaagacatccggaataatgtttaaccacatactgctctgaaaagtcaatgggttcattttttttctattaaaaaaccccaccacatatctcggcattgtggcccagctaagctgacatgtaaaattaagatatcacagcagcgctgagagatggagcttccgtctctgctactgtgttctgttcttgtgtaaataatgtaacacttagggcctcagttttcctctctgtaaaacaaagggtttggactaaaagatctctaagttcccttccagctttaaagttcttttaaaaattgtggtaggacaggcatagtggctcgcgcctgtaatcccagcaatttgggaggccgaggcgggcagattgctcgaggtcaggagttcgagaccagcctggccaatatcgtaaaacccccatctctactaaaaacaaaaattagccgggtgtggtggtgggcacctgtaatcccagctactcaggaggccgaagcaggagaattgcttgaacccgggaggcggaggttgcagtgagccgagatcgcgccattgcactgcagcctgggcgataagagtgaaactctgtctcaaaaaaaaaaaaaaatcgtggtaaaatacatgtaacaaaaaattaccatcttaaccatttgtaacagtacagttcaacagtgttaagtgtatccccactgttgttcaatctccaggagtgtttcatctttcagaatgaactctccatacactaaacatttatttctccctctccacagcccctggatgctttcaatgcttgtgggtatattcccataagcagaattgctgggttctgtggtaattcttattataaggttttagggagctatcacactgttttctatactggcagcaccattttatattcccaccagtagtgcacaggacttccaggttctctacatcttttctaacacttgttgctttcaggtttgtgtgtatgtttttttgtttttgtttttgttttgtttttgtttgttttggttttttttttttttgagacggagtctccctttatcaccaggctggagtgcagtggtgtgatcttggctcactgcaacctccgcctcccgggttcaagtgatcctcctgcctcagcctcctgagtagctgggattacaggtgccagccaccacgcccggctaatttttgtatttttagcagagacggggtttcaccatgttggccaggatggtctccatctcttgacctcgtgatccacccgccttggcctcccaaagtgctggggttacaggcatgagccactgcgccaagccttgtgtgtgtgttttatagcagccatcctcataggtataaggtgatatctcattaagattttgatttgcattttcctaatgattagtgctgttgagcatcttttcgtaggtttgttagtcatttgtttatcttttttgaagaattgtctacttaagccctttgcccatttttaaatgaggttgtttttgttgttgttgagttataaaagttctttatatattctggatattaactccttatcagatgtgtgattcacaaatgttttctcccgtctcatggtttgtcttatccctctgttgattgcgtcctttaatgcacataaacttctttaagcctgtgaaatttggggttgcaactcttcctcccatctgtggcccatggctgcaggctgaggaccttaacctctctgtcctaaatgagtggtatgcctgccctcctatctctttgatgatacatatttcagaatagaactctaagttcttattgctggaatcaactttggaattcttgtccaacctcattttactcatggacaaacaaggccctttgtgagcaacagagctggatctaaagtgtgagcttctctctccttccggcgctctctgcactgcgatgcaactcgacaagtcagctggtctttgtaatgaactcctcaggaaacacaagcaattacaggaaaagacaaccaggctattaagagggaattttattctattgaaactctgttatggggaaacgtgtgtgtttgttataggtaatctatttacattttcaaaaacctttttttttttggtaattattttattttattttatttttttattgatcattcttgggtgtttctcgcagagggggatttggcagggtcataggacaatagtggagggaaggtcagcaaataaacaagtgaacaaaggtctctggttttcctaggcagaggaccctggggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttcttggtacagaacaaaatgaaaagtctttcaaaaacctttttactttctaaaagcaactacacatattctaggactgcaagtgctgttttctggtaaacggggagttgcttagaaaccaggaatgagggatggagaccaacggtcttctgtggatgaagtataaacagtaactcttctaaggaatcagtactaaccttgggaagaagatgagcatgatttttctctgtacaacctctacccctcttctgatgaaagcacctgcttttctttagggcctactccatcaacaggagcccatgtcgtttgggtggagcttcaggaatcggcatatgagtcagtccagaaaaataggcacatcccacccgccaaccacagtgactgattgcggaagaggcacttgaccccaggtcacacaagggggttccgtcctgggacttttgctgcactgttttgaaagaggcctctttccccctggtattgctagactagcaggccatgggcccgaaactgccagaacgcacccttgatgccacccgggtagagtcaggggagagcagggctgagagttggagacacagattcctgaaagcattgtttgagcgcgtggatccagtcttgctttaaatcagactttttagtaacatgaaccgatcaattcctctgctacaccagtttgagttgggtttctatcactagtgattaaaagagtcctcattagtccagattgtactttaagttgcttgtatacattatctggaggagagtataaaaataataggctataaatagtgagactaatattaagttattttaggtaataaaaagtcaaactgatgggaatagttctgtggggaaattgtgtgaagctatgttaacagtaagaaaagtgactaggttttggtgtaagtaaatgcctggtcacacattcgggaaataataatttaagttctatttctagtatgacacattgcaaggcaaagaataagtcattaagggctctttaagaacattcagtgcaaagatgctactgcacataacatattagaaaagtataatagaagtaaaacaggtgacaacgtttaaaaaaacaaacaaacaaaaaaaaacaggtggccagatgcagtggctcacgcctgtaatcccagcactttaggaggtcgaggtgggcagatcactcgaggtcaggagatcaagaccagcctgagccaacatggtgaaaccccatctctacttaaaaaatagaaaaaaaaaaattagcggggggtggtggtgcacgcctgtaatcccagctactcgggaggctgaggcaggagaatcacttgaatccgggaggcggaggttgcagtgagccaagatcacaccactgaactccagcctgggcgacacagcaaggatctgtctcaacacaaaacaaaacaaacaaacaaaaccaacaggtaacattcatcccactgttgcatagaatcacaacgggccggatgtattccgtctgagcttccagatccactgtctaccctctcccaccctgctctctgctcagcagacctgtgtcctttgtcctctagctggggtccctaaacagggatccccgtcagggaggggagagtggtcgcgtgtttgctcccctggtttcctcctgcagggcttcctcggggagctgcttccctagatcaggggtcacagggcttctccagtagcctctccaggcgcctgtggactctcaccttttgggctctgatcattgttgcctcccccagacctagggaagtaacagccctttggggcaagtcctgggctcccgctttgccgtgaccacactgggtactagtccctttattaaactctcctcaaattgcctaacttgcagatggcaactgtttcctatgatatgacataatatatcataacgcacgttcttttttttttttgagacagagttttgctctgttgcccaggctggagtgcagtggctcaatctcagccgctcactgcaacctccgcctcccgggttcaagcgattctcctgcctcagcctccctagtagctgggattacaggcactcgccaccatgccaggctaatttttgtgtttttagtagagatggggttttgccatattggccaggttggtctcaaactcttgacctcaggtgatttacccgccttggcctcccaaagtgctgggattacaggcgtgagccaccgtgcctggccacgcaacgcacattctatgtccacatttggaaaattacctttgattgtgagtgttcagcctcaagaaaacagcaaggcaggcaaagtctaaaggaggggaagtgaagagatcaagagctgggagtgtgagctagaacagtcatatcgggaccgattaaatgtgatgcctgaacttataatcttcatatgaataactgatcggtttgattatagactagaatgttagtaaagggaggacatcttacacctggagatatgctttaaataaataaaatggagtattacctcgtgcagaaggttgtacactcacgaaattcattactctaagaggcagtacaatttgaaagtaaaaatcaattccaaaatgctttaaatacacaaatgaaggagttttaagtcacccagggaaacctgaattttgaggttaatatcaagatgtgagaggggtaaatggactagagctgatctggaaatttttatgtttaataataaatgaaattttgaatataaataaaacttaggttagcttttcattttccaccttagttggcccttctgaaaacattcaccttatataatacatttacctctttcatttgaattctgaactactatctgctgccctctcaggacgttttaacctggagtccatggattcaaggggtctatggatagaattgtatttcaatgtagtctatttcttctccttgagtatgtatttcattttctacatttaaaaacgtgattctgaggagtccacaggagttgccagagtaccagagggttgtgtggcaagtcaagtttaagattcccttgtaggccaggtgcggtggctcacacctgtaatcccagcactttgggacgccgaggagggcgaatcatgaggtcaggagttcaagaccagcctggccaacatggtgaaaccctgtctctactaaaaatacaaaaattagccaggtgtggtggcgggctcctgtaatcccagctactcgggaggctgaggcaggagaactgcttgaaccccggaggcggaggttgcagtgagccgagatcacgccactgcactccagcctgggtgacagagcaagactccatcttgaaaaaaacaaagattcccttgtagaccaaaccagctgtctgggcttcccagggggtaacagagaagggcactgccttgcttcacaattcttgtaaggatcctggttaccagggcacttcccagcctttggagagacggggatctctctccactttggtgtggatgcagaagcacagagactagagttgaggcagaaacaagtaagaggctctcccagcccagggcctgtttgggaaggaggaagctgagctgccagggccatcttccaggcccagtacaggcggcacctcccttcctgattgctgccaacatagactctctctgcagttccactctctgatcccatcctgcacaactggatgcacttttggaccacgcactgggacaaaactgaatttaaaaatttaaattaggccaggcgcagtggctcatgcctgtcatcccagcactttgggaggctgaggtgggcagatcacctgaggttgggagtttgagaccagcctggccaacccagagaagccccatctctactaaaaatacaaaattagctgggcatggtggtgcatgactgtaatcccagctactcaggaggctgaggcaggagaattgcttcaacccggtaggtggagattgcagtgagctgagatcatgccactgcactctagcctgacaaagagaaacttcgtctcaaaaaaaaaaaaaaattaaatgaaaaataattgatcctagtgaaaaagatttcagtggaataaagatagacaaaaatggaaatgtttcaaatgagtgtcatggaaagatgaccaaagaattcaactgactgtgtgagtttgttccagaaaacatgttctttagaacaaaacgttctttagttccctacagggactcctagtgaccaccgccatctcattaataagtggctttgattcttggactcagtaaacaaaatggcttgaggcgtgtggaactgagtgtctttactcttttgaaaattgtactaaatgcttgtccctaagaggtttagcccttagacaatgcatggagggaaattatttgcaaaactccccactctctggaaaatcatttgttctggtcagattcctggaattcatatacagatactggggtctctcacagttttttctgccactttgggttaacttttcctccgggcgtttcagttctaagaatgctccctttgacagggaaaaacagaagcaaaatacacattgaggagttctgctttctcttgtcacccaccaacatgacaacactgaccgcaaacagcgtatccccttttttgctttgaatatgactttatgaagcccttgtacgggcctcaattcacgtggggctttcactttctcagaagcatgctgccatttgttccaccttacgttcctctgcgggcgaaagcaccccctgttcagctcaggctcaccttctcccacaatcacatcacaaacatctgcaaccttagggtttctttaagccccttcctcctttttcactgaattgagatttcacgggcacagtgaatgttcttaggaagtactcaattcttgagcatctttccagcgtctcaagccatggtatgttcttttaattggtaaaatctagggaccacgtctaactgggccctgccatttctctcgctattatatacttgaagaagacacagttgctttctcccaagcttcctgtcatttccactctgccaaccaattcctccttttggccaaatttagttcagagtggcagttccgcttactacttctccactctctggaagatgaaattgtcggcatgcaataataatagctgacgcctaccgagttctttctgtgccaaaggcgcctttaccatgaggaagcggaggcacggagatgctgagtgtcttgctcaagttcatccatctggcaggtggcgggatgtgggcattcgagccagggtctgactccagagcccaagttctgtttctcgctctacgcgcctgtcaaagactctggtttccgccggatggactttcagcaggtccgaggatgtgaagatctcccatcagcatctccccaccttggggtcgcctttgtgatagggaggggtctgtggtctctttcctgagtctggttgtgggagctgggtaactcccaatgcagtggacagagatacctctctggtatctctccttgctttccaccctcagccttctatccctgtgacctatgacagcacaccccctccactcctcatagggctttcttggttacttccaggatgtcttcatgttctccccggacgattcgtgcagacaggcttttcttaaacacctttgcttcttcccgcctgtggaccatcttacactgattgtagatgtggctggcaggaggataatggtggccccacctgtggaccatcttacagtcactgtagacgtggctggcaggaggataatggtggccccgcctgtggaccatcttacagtcactgtagacgtggctggcaggaggataatggtggccccgcctgtggaccatcttacagtcactgtagacgtggctggcaggaggataatggtggccccgcatctgggactggtggtgggttcccaagtggaatagttctctgtggatccctctctaaaccatggcttgagacgttggaaagagagttctgctctttccccccctaaatttcaataagttttgggaatgccacattttctgagttaagtaatctcattttaactaaatggctctccaaggctgctttcccttccatggtcattgagaatacatctccctttgccccacatgataaaaacctgcaatcacagttagaacaataaacacagagttcttaatatgcaccaggcgctgtgtctaagggcttacaggattgatttgtttcattgttcacaacaactattattatcaccattttacagatgtggaaatggaggcacagagaggccacaccactgctgaacagggcatttttgctcatagaacaaagtctatgtgagtctgtttcttttacaaattttctattaataattttcagccaatccatgtgatcaagaggaccctagattgaaagaagtatcatttcattgaaatgatttcaaatttaggccaggtgcggtggctcacgcctgtaatcccagcactttgggaggctgaggcagcagatcatcaggtcaggagttcgagaccagcctggccaacatggtgaaaccctgtctctactaaaaatacaaaaattagctgggtgtggtggtgggcacctgtaatcccagctactcgggaggctgaggcaggagaatcgcttgaacccaggaggcagaggttgcagtgaggcaagatcgcgccactgcactccagcctgggggacagagtgagactccgtctcaacgaagaaaaaaaaaaaaaagaaagaaagatttcaaatttagtattatcaaatttcacctataggccactatatacttagaatctattagcttctggtcagtaatttaaattatcacgtttgttattataattatgtagaattgtaatttcagaatagcttaaatagtaatttgacccaaactgcaaatattcttctcacataaccgactgtaagtcagttctatcaatttcttatttttaagtttggtttgagattacttcacctataaacatttatggtctattaacgtttccgctaatattttgagcatgttgcaaataaagttttttctatcttgttatgcagttttggctaacatttaactcctatgctgttaggcatttccagacctaacttaccctaaagtatagcccaccaggaaacatcatctcagaatatcagacactactgcctctgtaaataattccattactctgtcactcaagtgactcagttcccactggggtaatagactgtcatttttgacttttgccaattgaattgcagctctggtttccctgggagcccggcagctttgcacatagctgtgggtaatgcagcgggttactctggcaagacttgctgtcattgctttctgctaattccaggaaaaaacttattttacctttccaaatcccagtacctcttttcttcccctgtctctcctccttttctcctcacctttctcaacttggaggggtttagtttgcattttttttcctacatggagaatgagtcagggtttttttgtttgtttgttttgttttgtttttgtttattttttatttttattttttgacggagtcttgctctgtcgtcagactggagtgcagtgcacgatctcggctctctgcaacctctgcctcctgggttcaaacaattctcttgcctcagcctcgcaagtagctgggattacaggcacgggccaccatgcccaactaatttttgtatttttagtagggacagggtttcaccatgttgaccaggatggtctcgatctattgacctcgtgatccgcccgcctcggcctcccaaagtgctggcattacaggcgtgagccactgcgcccggcccatgagtcagagtttttaactgcaaacaacagaaactgattctgattcacttgagcaggaaaggaatttattggaaggatagtgggtaaatgtcagtgcgaaggctggagacgcaggtgagcaaatggcagcagcaggggaggtgggcagctgcacccacagccatggtcatgccagggggcggcctggttggaaggctgtgtcactgtgactgcctgggacatcagaggctgcggctgccacccctggagcgaggcagcttcctcacatacttgctccatgcccaggtttcttagcacacattccgatggttgagcccagatcatgcaaccaaatcctaatttccaagggataggcctctgtttccaaacaacgccacgcaagaaaaggctcctcttagccgtgaagaggttcagacgctgagcacccgtcaaacacaacccctgcaaatactgactattatagattccagctctggggacatcgtccttttatcctcaaacagaagaagagtcatttctgctctcaaagggatgagtgcacctttcttcttaacaaggaataccaacttcctgcagtttcctgatatttaacattatctagttactttatataaattatataattttaaaatatttatattattcttaatataattatatttaatacattatactaatatgttatataatttattaatatagtagaatatattttatatattaatgatctccctagtaatcatctccaacataagattaaggataattgtggcaattttaaaattttgttttgtttttgagacagggtctcgctttgtcacccaggcttgagtgcagtggcgcaatcttggctcactgcagcctcgactttctgggtgcaaatgatcctttcgccttagcctcccgagtagctgggacaacaggcgcgtgccaccatgcctggctaattcttttgcattttgtatttttgtagatatggggtttcaccatgttgcctaggctggtttcaatctcttgagctcaagggatccacctacctcagcctcccaaagtactgggattacaggcatgggccaccgtgcctggcccagatgattctatattttattttattttttattttattttattattgtatttttttgagacagagtctcgctctgttgccaggctggagtgcagtggtgcgatctcagctcactgcaacctacgcctcctgggttcacatcattctcctgcttcagcctcctgagtagctgggactacaggtgcccacgaccacgcctggctaaactttttttgtatttttagtagagacggggtttcaccatgttggccagaatggttttgatctcttgaccttgtgattcacccgcctcggcctcccaaagtgctgggattacaggtgtgagccaccatgcctggccgataattgtattttaaataagaaacctaaagcttcaaaatcctcaaaatataatacttaaaaacatttatacagatattaaaggaatagttcaatagcagtgaaatatttttaatttgagaagccaaatacatattcatgaatcactctagagatacaaagagaaactgcacaatttcaaaacagtatggtcaaaatatgatgtcattctgtttaactagctttaagatgttgctaggtgctccaatgttctaatttagactataataggaaaacacatgttttacataaatgtattttccaaataactagagagtatcagtttaagcactaatcttttttattctgattttcaaaaaatgttaaacaaatcccacttcacggggattacagatgtgagccgccacacttccctttcttgtatactgagtctatgttaacctattctttttttctggcgtgatctcggctcatttgcaacctccacctcccaggttcaagtgattctcctgtctcagcctcctgagtagctgggattacaagcatgcaccaccacacccaactaattttgtatttttagtagaaacagggtttcaccatgttggtcaggctggtctcgaactcctgacctcaggtgatctgcctgcctcggcctcccaaagtgctgggattacaggcgtgagccacagtgcccagtggtttatttttatagaacagctttattgagctataactcatctaccatataatttacgcatttaatgtgtacaaggcaattgcttttagcatgttcacatactcatgaaaccatcaccacaattttagaacattttcataacctcaaaaggaaaccccatacccattaccagtcactcccattttcccccaaacccccagacctaggtaaccactaatctttctctctctacagatttgccttctctgaacaattcatgtaaatgaaatcatgtaacatgtgatcatttgtgactgacttttttcacttagcataatgttttcaaagtttgtccctgttgtagcatgtatcagtactttattctcttctatggctgagaaatgttccactgcatagctgggcgcagtggctcaagccagtattcccagcactttgggaggctgaggcgggtggatcgcttgagctcagaagttcaagaccagcctgggcagaaaccccatctctaccaaaaatacaaaaaattagtcgggtgtggtggcaggcacctgtggtcccagctactggggaggctgaggtgggaggatcgcttgagcccaggaggaggttgcagtgagctgagatagcatcactgaactccagcctgggtgacagaaagagatcccatcaaaaaaaaaaaaaagaagaaagaagaaagaaagaaagaaggaaagaaaaagaaagaaagaaagagaaagaaaagaaagaaagaaagagaaaaagaaattccactgcatggatatactgtatccactcgtcagttagttgatggacatttgggttttttccacttcttggtaatcatgaatgatgctgttctgaacattcatgttcgggtgttagtatagcatggcttcaggtgttagtatagcatgtcttcaggtgtttgtatagcatgtcttcatttcttttaggtccctaggaatggaatttgtgagccacctgataactccatgcttttaccttttgaggagctgccagactcctttccaaagtttctgcaccatcttacattcccaccagcagtgtatgagggtcgcagtttctccacatacttgttttatttgaccttttgatgctaggcatcctagtgcatataaagtgatatgtcattgtagtttttgtttttggggtttttttagacagggtttcactcccgtcacccaggctggagtgcaatggcacaatctcggctcactgcaacctctgcctcctgggttcaagtgagtctcctgcctcagcctcctgagtagctgggattacaggcacaggccactgtgcccggctaatttttgtatttttttgtagagacggggtttcaccatgttggtcaggctgggtttgaactcctgggctcaagcgatccacctgcctcagcctcccaaagcgctgggattacaggtgtgagccacagcgcctggcctctcattgcagttttgatttgcatttccctgatgacaaatgatatcaagcatcttttcacatgattactggccatttgtataccttctgtggaaatgtggtaacaccctttgctgattttaaaatagggttatttgtttattattgagttgaaataattccttcttttgagtgtcagtgactgaggttcgctgtgacacagaggggttctcctggagagctatggcacatgctccatattaaaaggcaacatgatgctgtcaggaagaacacaaaagcaattataaaaacgtgttagtacatatttatgcatcttttttcttactctctctttgctatctattctcacagctctaaatatgaattatttctctaggtagaggccaagcatgagtcagcttctcccaagaatcagttgcctgggcttcgagacagttttctgccgtattttgggtaattgtagttgccaggagtctgacttctgagggtgtcaggtgccatttgccgttaagtggagatagtaggttgaacagggtgggactaattggggccagttttgaggaggtgaatctttagtgaaatcgccaagaacacagtggtgaggacctggcagagaggaggagattccaaggctgggggaattgggtagtggcgtctgggcactgggtcctgtagaagggaattggcgagatgaatgagcagggcttcacaggtgtgactgatcttggtaaagacggtgagaagccgtgaccaggcagggtgtgcatgggagcagtgaaaggtctaaaattcagcctttgagctcagtgctaggttcatgctagtaattggttccgataggttaagcttcctctggtttgccggtgtgagaagaaagaaaaacctactcctccctgtttccgcctcaccagcttcccttctctgccagccccaccctgcccccggcccgtgtggctaaactgcccaactgccgattaaaacccgcacctcccaacatacctcgcaccacccagaggccccggtccccgccattcattccgctcccggccgggagtcgctctagccaatcaccttccaggctcagggcggccgaggcagggcctctgcctcttcggggggcctctccctccccctgcccctgattgtggctgaactgccaccgcttgatagcaaaccacactcggcacaggaaggagaacagcgcccgcggccccgggcctccatgaaatcagcaagggcgcgctcctcccaccgccgcgctgctgagcctcccgcctttccttccggtcgctcgcgcctcgagaggcgccgcagggagccctctgccggtcccgcccttcgctgttagcgcttaggatctggtgccttttcacgtgggggcgggtgggcgggaggcgagtctggggtcttcgggccgggcctccgctctctggcagtttgcaccttgctccactcactggcctgcggtctgtgttcactcctcctcctctcccacgtctcaggaacctgcagctggcccccgagcccgcgccctcccggttctaggaattcaccactttcttgcctttgtttgggtatcttttgtttggagccagagccggctccaaggaggagctgccggagggtgctaggctttttgcagaggaagtgaggagcagagtgatagggcgtgaagtcagagggagcagagaaggggccgaatccagcggggcccggatcatgcagggcccggagcctgtggtgaggactccgggatttatattcaccaattatgagaaaggacttctcggccgggcgcggtggctcacacctgtaatcccagcactttgggaggctgaggccggcggatcgcctaaggtcaggagttcgggaccaccctggacaacatggtgaaactttgtctctactaaaaatacaaaaattagccaggcgtggtggtacatgcctgcaatcccagatacttgggaggctgaggcaggagaatcgcttgaacccaggaggcggaggttgccgtgagccgagatcgtgccactgtactccagcctgggcaacaagagcgaaactccgtcaaaaaaaaaaagaagaagaagaagaagaagaaaagaaaaaagcaaagaaagaaaagaaagaggacttatcaatgaccacaaatgactaagtcctcaacctctccaacagctctagagcaaatgacactttagcctgtgctgagcccctacaaggtgctagaccaagtattcttggggatatatacaaatgtgaacaagccagagaccctgcctggcaggactcactgtccagggggaaggcaaaactgcaaagatgagctgggacgccccatgggaaacgctggacagagtcagccacaaagccatccccttgcagcctcctccttggcatggccttattttccttgttggatccctagtgtcctaccccatgccaggtcccaccccaggagggtccagttcacacttccagaaagtttgggctgcactgtcccagcggctgtgcccttcgtgctctcccgctcccaggactctcccagcaccgcgtgcccattttccccaaggtcctttcggccctggaccagaccatggttagttatgggtgccccttcccctcgctgtcccactccacgccctggcactgataggacacttccatgttatctttgcaccacctggactctttgatcatatgttgatactgtcggtgtttcaggacaggaagaggcagtgtccccacagaggtcagtcaccggagtcagtggctgcgggaggccatgggcagcagggagctagaggagctgatctcaggattggagaccgccacctcctccaggaggagaaacacgcggggaagagcccccagccccaccccacccccgcactgccttcagcctctgcattgacccctccgcttttccaggatgggcatcatgaggcgttgagtggtaccaatgtgggcggtgggctctcctctttccggttttaattcttggttcttaaaaactccgttccaaatgagggaaatgaaactactgaacactctcccccagcagccagctgacgtggggcaagagaacaattcccagttaaggccccaaaggaaatcccctccctgccatgtgctgaggctggagaagtgggggctggagaactggagaagtgggggctaggagaagtggaggctggagaagtcggggctaggagaactgggggctggagaactgggggctggaaagggggggctgggagaagtgggggctggagaactggggtctggagaagtgggggctgaagaagtggaggctggagaagtggggactgggagaagtgggggctagagaagtgggggctgggagaagtggggactgggagaagtgggggctagagaagtgggggctgggagaagtggggtctggagaagtgggggctagagaagtggaggctggagaagtgggggctggagaagtgggggctgggagaagttggggaggctctatctagctcactgctccgccaccaaggtgaagggcctgtctgtggccagcggctgagagcccacagcacagcggagaaccccagaggcaggagcaagaggaccatgattttgcccggggtgagccgccagttccaggtccccatggctccactgctaggtgcaatccctgtgctcctctctcacagacctgtctggagtggggagcagccctggctcctcccatggctcccttgcacaccgagttgtgtcccctctcacaggccagctgtagccccctcccctggtcttgaataggttgccatctggaaaagcagtcaggggtcggggtggagggcagaagccaaggctccctttgatctccttgggaggctgagaagtcccacaagtgacaaactcttatgaagcttagtttaagaaagaaaagagatccccacaccctcagagggcaacagctagagaattatacaaagtgggttgaccgccatcattccttccttccctctcttcgtttctttcctccttctttcttttttgtggagatggagtttcgctcttattgcccaggctggagtgtaatggcacgatctcagctcactgcaactgccacctcccgggttccagcaattctcctgcctcaacctcctgagtagttgggactacaggaatgcaccaccacgcccagctaattttttgtatttttagtagagatggggtttcactatgttggccaggatggtcttgaatgcctgacctcaggtgatccacccaccttggcctcccaaagtgctgggatgacaggcgtgagccactgcgcccggcctcctcctcctttctttgagcaaatagtcaccaagcccctttatgtgcataagatagtatattttttggaataacacatgaccctgcctccaaaagtttgtagtgggccaggcatggtggctcacgcctgtaatcccagcactttgggaggctgaagcgggcggatcacctgaggtcaggagttcaagaccagcctggccaacatggtgaaaccccgtctctactaaaaatacaaaaaattagctggaagtggtggcgggcgcctgtaatctcagctacttgggaggctgaggcaggagaattgcttgaacccaggaggcggaggttgcagtgagccgagatggcaccattgcactccagcctgggcaacgggagtgaaactctgtctcaaaagaaaaaaaaagtctgtagtgtagttgtggaaaaaaggcagaagtccaaaaaattaaatcacaacacaagagatgtcatgaggtcggtggattatgggaacgctggcaccatgtgttcacaggacaaggtggcaattgcagtggggaaggcttcatggaggaggggagtccaagccatgcctttgggatggggagggttggggtaggcagaagaggccattccaaacaagggaaccctctgccagagagagtagagagtggggagcgtttgttctgtgtttgggaaaatcgtgatcagcccgggctgggtgaacccacctgcaggccatgtgtgcagtgatcatgaagcatgggcggtagtcgtgaagagaggctggaggcagctcaggccgaatggactttctcctccagccgggagccgcctgggttcttgctttcacttcggatcagagacgctgctgcgctgcttgacactagacttgctttattcctgttgagtggaatacagcaaacaccccaataggtggagcaggctcaaagcaagaggcacatggccccccagaaattctcatgatcctgtggaggggtgagcttggtcagggcaaccaggcctggatgcaccagggttgcatctgagaggaagcaccctggtctcctctgcctcgaaaagcatagtgaggggggagcccaaccaagttggaggatgctgagctgtgcagtcgggcttccagccgtgctggcacgttctcctttcagctgaaatctgcattggtttcagctggacgtccaggcttccacccactgaggcagcgtgctgctagcctaggggagggctgctggtgttgccaaccaactggcttgtctctacacatccatcaagagcactggggccgggtgcagtggctcacacctgtaattccagcactttgggaggccaaggtaggcagattgcttgagcccaggagtttgagatcagcctggacaacatggtgagacccctgtctctaccaaaaatacaaaagacatggtggtgtgtgcctgtggtcccagctactgaggaggctgaggtaggaggatcacctgatcccaaaggtcgaggctgcagtgagccttgattgcgtcactgaactccagcctgggcaacagagtgagaccctgtctcaaaaaaaaaaaaaaaaaaaaaaaaaaagaaagaaaaagaattaaaaagaaaaaaaaaagaccattggtttactagattttttttttaggggtagcagctgcctttctcaaaagaaattctatagagaatctcccaatgtataaaacatatcaaagtagaattcttgggatgtggagggaatggggtacctggatcccacctgccagtctttaggcattcatgaggaacccttgaacctgctgaaccctgtaaaagggctttaagcagagagtgagatgacccaatacacattttagaaagatgcccgtggcagctaggtggagttgacattggacagggatgagattaggggcagggagcgagtttcaggaggctatgaaagtggtccagacatgagctgatgaggtctagacccagggcaacagcctaaggatgaaaagcaggttggattccagaaacatttctgagttagaatcagcaggaattgggggtcaattagatatgaaggatgaagtctgtgagggctggactgcctgggctgaaacataccgtaaagtgtgacagccatacaggagagaaactgctgggacaaaggataagagttgagtttggggccaggcacagtggctcatgcctgtaatcccaggactctgagactgaggtgggcggatcacctgaggtcaggagtttgagaccaccctggccaacatggtgaaatcccatctctactaaaaacacaaaaattagctgggcgtggtggtgggcgcctgtaattccagctacttgggaggttgaggcaggagaatcacttgaacctgggaggcagaggttgcagtgagctgagattgcgccactgctccagcctgggtgacagagcaagactgtctcaaaaaaaaagagagagagttgagtttgggatacatcatgttatggtgactctgggacatgtagcagttgattgaccagtagacagttaaaaatgcaagtctggatcttctctcgtggaagagaatgttggagctagaaattaaaattggggagttaccaactgattggtagacacaaaagacatgaagtagagaatgtgcatacaagagagaaagaggcctgaatcaagcacctgggtttgcaacaatttgatctttatttagctttttcattggtgtgattgttattaccattatgagataatattttatttttaaaattatttttatttttttaaagacggagtcacactctatcacacaggctgaagtgcaatggcgtgatcttggctcactgcagcctcaacctccctgtgctcaggtgatcctcccacctcagcctcccaaatagctgggactacaggtgcgtgccaccaggtctggctaagttttaaattttttgtacatatggagtctcagtatgttgcccaggctggtcttgcactcaggcggtccacctgccttggtctgccaaaatgctaggattacaagcctgagcctctgtgcccggccatgagtgaatattgtagaaagcagagacaatgtgccagatgtttggagtgaaaaggacttggctcctgttctcttaggatggacaatgctacacacaatcccaaatcacaggctataagagaggtgacccaatcctgcaggacagttcaacgtttcagatttgaaggggagtgagagagatcagaactggaggccccttgtctgagcccccgactatggtggtccacgtcactccacacgcagcaggcactgtaaatatttcaccttctctagacgacagtagttcctcgagaacaggagcgctggggtaatgcatatgaagctcttagcacagtgtctggcgctgcttcaatgatggctatatgatcaattattcttactcctttgaattcttggcaagagctggcagggaactttgtacacatcaggtacaaaaaaacccatccgcgcagtctaagatcaagaagctcttggcactctctgacagtcctcgacaaagcaattccccttctttctaacacagggtccgtaaaggagatgatccacaaggaccggctgagtggataagaagacagactggctgagcggctgaccctgccagacgacaggctgtgcctctttaccacggtgctgccgttcccaaagtcggcctcagcttggtccttggctggaagctcgtagcaaagtttctgggtcagcagacctcataggcaaggggcccctagctggccgcccccagccctgccaaggcaccaacgcaagaaagccgggggagcctcggtcgcattgctggaagatcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaaggtgacaccgaggacctaccaccagccaccaccagcatgcaagggcgaggtgtcacctcccagtgggagcaggtttgcatttattaagacctgtggccagatggcagcctgtgggcatggaacaggacgaggtgggctgacctctgatggctctaccaggccgacgctgaccacgtagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgggaaccggagatctgagttgaaccagtgctgggaaccatggcactgccttcgccgagccgccgcgtgcctctcttttcacctctctggcctgcatattcttttagcaaacttggggattatactacacattctgctttacactttcctttccttgatattattttattatgaacgtctttctgcgtcaatcaatatattgctaccaaagcatttttttatcataccacgtcattcctatcatgtagttttaccataacttatttagccagtgcttccattattggacttttgatggtttccacttttttattattcttactaatgttacaatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccacttcgttgtccaggctggagtgcaatggcatgatctcggctcactgcaacctctgcctcccaggttcaaatgacactcttggctcagcctcccgagtagctggaattacaggtgcctgccactatgctcggctaatttttgtatttttagtagagacggggtttcaccatgttggtcaggctggtctcaaattcctgacctcaggtgatctgctggccttggcctcccaaagtgctgggattacaagcgtgagccactgcgcccagccacctggctaatttttgtatttttagtagagacggggtttctctatgttggccaggctggtctcgaacccctgatctcaggtgatccacccacctcggactcccaaagtgctgggattgcaggtgtgagccactgtgcccagcctgtatttccatttttaacataacaaatgtttcctgagcacctttctgagaagagtgtttgaaaaaggtatgttaatgattcctggaaatatggggacagagattaccataatttaacatctcttttcaggaacacttatttcattttcctcatttttaaatgtgagtactttaaaacttacagaaaagtttacaagaaagtacaatactaaatttaccgagtagtaatattttgctttactgtctctattgagccatttgaaggtagtttacataaattacggacatcatgaaagttccctgtaagtgcttcagcatgcatttcctaacaatagaggcgatgtcttacataaccacaggcttgttatccgacctgcagacctcatatcatctgtgcatctgaaaactcatcacttagtgcctatttaaatttccccaattgtctcatacttttctgttagagattctttaaaatccaacatccggccaagctcagtggctcacgactgtaatcccagcattttgggaggctgagttgggtggatcacctgaggtcgggagttcaagaccagcctgaccaaaatggaaaaaccccatctctactaaaaatacaaaattagccaggcatgctggtgcatgcctgtaatcccagctactcaggaggctgaggcaggagaatcacttgaacccgggaggcggaggttgcaatgagccgagattatgccattgcactccagcctgggcaacaagagtgaaactccatctcaaaaaaaaaaaaaaaaaaaaaaaattccaacatccactcaaggttcattcactgcacttggttaaatgcttcttagtcacttgtaatctagaacagacacccccagccccactccagcctttctttgattttcaagactgactcttgagaagtccaggccagttaccttgcaggacgtcttacagcccagatctgtcagaggctttcctcatgactggattcagggcaagtgtttctggcaggcgttccaccaggacagtaccctgtttcctaagtcatcacactcagaggctcagaatggcaggagctctcaccacgggggtgttgagtttggacatttggtgaaagttgaggtcatcctaatgttttgctaagaatcagagggaccagagctgcttgcttgagacttcccagtgcttcctggagaagggactgttggaaatggtcacagactgggggttggttttgttctgtatcatctgttctcagtggtctgtgaccagctgcccttcccattctcccagatcccaggtgcaattgctctttttcttgcagtcaaaggcagactccctttcttgtggaggcctccatccggcaccgtgtgcccttgtgtgtccatgagtgtcactgtcacacatttaccactgcacctgtgcgcactctgcctctggagagccctcccccagacccagggagaaatatttgtttctctcttttttttttgagacggagtctcgctctgtcgcccaggctggagtgcagtggcgtgatctcggctcactgcaagctccacctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtgatcacccgcctcggcctcccaaagtgctgggattacaggcgtgagccactgcgcccggccaaaatatttgtttctagcacagagtgccccgagagctgcccactttctccaggagacctctttccgtaaagctttttcagcttctctgattactttgaggagaaaattcttaactacgtggtaacatacgtatggcacttgctcagagcccctttagcggagagggtccggtcccagctctggcagcagctgctcacgtagtagcagtcaggggaggtgggggtggggacggtaaggtgtccgagcagctccaacaaggagaggccgtcactctggccgggataacaattcagatatccagcgtgcacctgaatagtagaaatccagcatccttttctaaaaacaaaacaatagcaaaattcagatctgagctactctgtagcatttctttttttagagacagagtctcgctctgctgcccaggttggagtgcaatagcgagatctctgctcactgcagcctccacctcccaggttcgattgtcctgcctcagcctcccgagtagctgggattacaggcatccgccaccacgcccagctaatttttgtatttttagtagagacagggtttcaccaggttggccaggctggtctcaaactcctgacctcaggtgatccacctgcctcggcctcccaaagtgctgggattacaggagtgagccactgcgcccggccatttttgtattttttttagagaggcagggttttgccaccttgctcaggctggtctcgaactcctgagacccagtgaccccccactccttggcctcccaaagtgctgggattacaggcgtaagccaccgcacctgttcgcaacaaacataatttctaaaacaaaggagactctttgcagcggctgtacgttcttcttcctcactgtcagcattctcttgttgcagaatacaacctccattcatgttgtttttatgaatgaatctttttaccactttcttactatgaccaggtctggaggcagaaaaccacgttgtcttctctgcctaaaaagcaacaccacatcttcatagacaaggttggctatggagtagactcacagcattccatgataactagttagaatgcagcagtgttccaaatgggccaaaccttgtccagacaggagcaacaggcagctcagggtcccaggaacactcaccagctggcagcccctcgggaagcggctgggctttccacctgttcctgcatgctgggcacactctggcttagatgccctcttacagctgcagatgctgtggcgtggtcctcagccctgaggatgtgggaggagaggaagcagtcctgtgcatgcaggggatgagtcacgggattttgcagagagatatggcaagaggattgtttatcttggactctttgcagtgccatggctctgaggaagctctctgcagctacacactctacgaagagtgtttctcaacctcaatggtcactattttgaaagccttttatttctttacagtcattacatacttttaatttagcactgggtcttggccattctcacatgattgtattagtcagggtccaaccaggaaacggaaactgcccagattatttaagacagaggatatttaatgcaagaaagtggcaacacatggtggaaaaggctgagaaagcaaataaacagtcaacacagcgacgagcagcttcaggaagcttcttatcctcacctaggtagggtgaggacaagaggagaaggtgggccaggcaccatgactcacgcctgtaatcccatcactttgggaggtcaaggcgggcagatcacctgaggtcatgagattgagaccagcctggccaacatggtggaacctcatctctactaaaaatacaaaaattagccaggcgtggtggcgtgcacctgtaatcccagctacttgggaggctgaggcaggagaattgttgaacccgggaggtggagtttgcagtgaggcgagatcacaacattgtactccaacctgggcaacaagagcaaaactccgtctcaaaaaacaaaacaaaacgaacaaaaacaaagaggaggaggtggtgtcaccagagcctaggggtcagcggaagaaactctaggatgtctctgtccaaggcagagaggaagggagagaagtatgctggattctttctgccctctactgtctgacctcccaggaggagtgtcttccattgactaaaccagcagagtttgtgacaggtgacagcagtttgaggccaggtgacagcagagtttgagattcagaaccttcagaagtcagagccctgccacactgaggagggcagggaaggggaaggcgcagctctggggacaaaccgctgtcagccagcatagtcatctgtgctcagggctagccttgctctgcaatttatgaatgcagagtttttaattgaaccttcctgcatatgttttacatatctagttggtataattcatccttccagccacattactcaggcctttattttagactttgtgtagctgttgaactaccttggagattacacaggaataaccagcactcagtcaactcactggtgtttggaactcacaagtaataattaataattgtgttacttgctacctttacagccatgaagccctttcacattcatgagactggttattctcatgcaactctggaatagttattattactcccattttgtagacggattctctgagtcttggagactttgtctgaattcctaaaggacaaataacaaataacagaggcagaattcaaactctggtctgcttggttccaaattccatgatcttcccatgatatcctgctgcttcctgccagggccacaacaagagtttttttctgggctggttggctgagtttaggaggaaggagaggatatgttttaaacttgcaaaattcttgatgacccataaattaaaatgcccctcctgagtgtgacacaaggcctggcttgccttccagtctgaaggttgccttttcgctgagggacctgcactcttgccccttacacgtctagattcagttcttcgatacgcagggctggctcttccagagagactggagtcacagcagcaggtaccaccccacacctgacaagaggtggccagggaggaagggagggttcttacctccccatctcccctcagtaaaattcaggatgcccagtgaagtttgaatgtcagataaacaatttgttagtataaggatgtatctagcattgaaatgatgccttgtaatttactaaatctgcaactatgcagccttatttcatggcgggcagtggtggtgatcccaggtttcaggggcggggaagggtgctggggggatcctgaggtcaggaacccgtacacctctgcttctgccctctcttccctgtgccggccacaaggcaatgactcctgtgtgggtgcagaggcagaaatgggtctggaaggggattcccagtgtctggcaagttctggtaaattctgcattggaggttctctctgtagtaaggggagttggcctggcctgaagtgaaagctggcttacccggtttcattgagctcttcaattagtctgtttgcactggtgagcattcaaatctgatcaagaaggtaaaatgagctttcaagatccctaaatgcatttgaagaaaggaaagaggaggcccctgagtggctggagcgagcaggtggggtgagctggtgccgctggcccaggagaagatgggagggcagacactgggcctccggtaggtgtcaaggaatgggcagatggaatgctggggccagctcttgcctctgggtctgcagaatgcagagctgggggcatgcactgggcgtcaggtccccagcagggcagcagtgagtgcagcctcgctgctgggagaaactgccctgctcactcatcggagctcggggagcgaggcggggctgctcttagccctgccactaagttcatccacaacctcgagtagtatctctgggcctttgttcacctggcaaatgtgatgagtatattgcatttcccttatggctccccttagttctgaatctctgctggtgcgtgtataccttcaagccttctcattattgctgttctctgtgcactggccaggcaagcgggctggcaaccacgtttcgttaaccacctttattctacccaaagattgcttcttcattttccctccgtgtttcccccgtccaagcaaaatatcaaacctcttttttcaaagggtcatagtcaaatgagtgaaccaaagagatcaacgcttttgtaacagccccacatcagcagctgaggagtaactctgggacagaggcccccatccgtgtttccgtctccgtccactctccagttgttcattcattcactcagcaagtacttactgagctcaggggatgcatcagaccgattggagctggaggcaggaaaacttcagcagaattacaaaatatgggaaactccaggtgactggaggcctggttactcaagctttttgcttctcccttctgtgctggactcgctgaagtttagtgttcagccacccgtccatcaagtggtagaggcaaaatgaaattgagttcttgtcaacagtttcagtgaaaggccggaagtcttggctaaatggaggtatctgagtatcctgtgggctgcacctctatggagctccacagagctccaagaccacatagaattggaactggctccttctgccgataatacaaacagccctctgggatgtccttctctgacttacctcttccctgctctctgtccacagggctgcccttgagatggagttgctgcctctttggctctgcctgggttttcacttcctgaccgtgggctggaggaacagaagcggaacagccacagcagcctcccaaggagtctgcaagttggtgagtttcccttgaaccctgatctgtcggctgctcctgtcctgacaaggcttggtccatttggaaagctgacagattgtccatcaggaagggcagagaatgaaggagcctgcatcactctgtgcctgcctagcacaggggcatgtgcagctgccctttaaccacaggattttaagatgcttcctgggaagagccaggcagtccctgccccgccgttctcacgcctgctgaggataggaggcatccgagaccagcctagggcatcctcccggaacaagaacaacttgttaaaaatctggatgattcaggccgggtgcagtggctcaggcctgtaatcccagcactttaggaggccgaggcaggcagatcacttgagcccaggagttggagactagcctgggcaacatgatgaaaccacatctctacaaaatacaagaatcagtcaggtgcggtggcacacacctatagtcccagctacttgggaggctgagatgtgagggtggcttgagcccaggaagtggaggttgcagtgagctgagatcatgcccctgcactccaacctaggtgatggggccagaccttgtctttaaaaaaaaaaaaaaaaaagccaggcgcggtggctcacgcctgtcatcccagtacttagggaggccaagtccggcggatcacctgaggtcaggagttcgagactagcctggccaacatggtgaaaccccgtctctactaaaaatacaaaaattagctgggcgtggtggtgcatgcctgtaattccagctacttgggaagctgaaggaggagaatcgcttgaacccgggagacggaggttgcagtgagccgagatcacacccctgcactccatcctgggcgacagagtgagactctctcaaaaaaagaaaaaaacaaaacaaaacaaaaaactggatgactgagctgcaccgatggtatgagaatctccgggtgaggtgcttgagagctggagaagcctgcctcggagtttgtggacgagttgaccgctaaggcttacacagctgcggggaggacttgctgccatgccactctgcagagcggcagcccggaccacgctcaggctaagaagacccggagcgtggatacccaagcctcctctagggctttcagcctagatgtgaaaatagacttgggtccaaactgagaaatttccagtaattttccccttcatctatataacaatgatatcaaaagtctgctcaagaaacacatatttaggccaggtgcatggctcacgcctgtcatcccagcactttgggaggccgaggcgggcagatcacaaggtcaagaggtcgagaccagcctggccaacatagtaaaaacccgtctctactaaaaatacaaaaattacccaggcatggtggcacatgcttgtagtcccagctactcgggaggctgaggaagattgcttgaacctgggaggcagaggttgcagtgagctgacatcgtgccactgcactccagcctgggtgacagagtgatactccatctcaaaaaagaaaaaaaaaatgaaacacatatttaataaacatttcttgagccatattatatactaggcgttgggaagacaaattggatgtcagggctaacacttacattcaagtatgtattcttaaagcatagctgtcatggtttttaacctcttttagtaggaacctataaccactgtgctagagtctattccaatatgacatagaggttacaagctagactggcctggtttaaacccagccccacccttagctggtgacattggggtcactctaggtcatagtttctccatctgtagaatatatacgtaataataatatctaccaataacatcatgctgtgttgactgatgattaaatgggttaatacatgtaaagcactcaggacagtgcctggtaggtagtcagtgctacgcgttttatccgttatcactcatattattattaatctctgctatgtttgacctccagcattctcttacagaggcaataaaggattaactacacagtagttattcaggggttaccaggcacaggaagaggagagataaatgaacagcctttcagagttcaggcaaggccctctgcttgacactttctggcccagtgggcaggagtagagaattggctgccaggaagcccaaagagtgggtttcctgtggctcttccgagttgaggactgagaattggagagtctgggtgccctccactggccctcatcacattatccatttgaccttattagaaagtggacgttggccaggtgcggtggctcccgcctgtaatctcagcactttgggaggccgaagcaggcagatcacctgaggtcaggagtttgagaccagcctgaccaacatggtgaaagcccgtctctactaaaaatacaaaaattagccaggcatggtgacgggcacctgtgatctcagctactcaggaggctgaggcaggcgaatcgcttgaaccagggaggccgaggttgcagtgagctgagatcgcgccactgcactccagcctgggcgacagagcaagactccgtatcaaaaaaaaaaaaaagaaaaagaaagtggacatggtaagcttttctgggatggccatatggtccttctacatcacttcagcggggccacagggaattgcagaggtgtgacccacgactgcagcagctgtggtggaacagcaccccatagcgtgaagaaagcccctgaccacaacattctccagtgagtccacacgcagggaggagcgcaacacccactcacataaagacacacacctggccgggcgcggtggctcacacctgtaatcccagcacttggggaggccaaggcaggtggatcacccgaggtcagggtggccaacatggcaaaactctgcctctactaaaaatacaaaattagcccggtgtggtggtgtgagtctgtaatcccagctacgtgggaggctaaggcagcagaatcgcttgaacccggcaggcagaggttgcagcaagcagagatggcgccattgcactccagcctggacgacaagagtgagactctgtctcaaaaaaaaaaaaaaaagataaaaattctcttccagagtactttgtaattataatgcaatcccaatcaaaataccaaagagggaagggggatgtggaaagaacttggcaaatcctttctaacgttcgtctggaaattagagaaacccaaatgctcaacaataggagatgattaattagatcatcctaataattatagctcacatttattaagcacagtaaatgtgtttcacctcaacagtcacacttgatcctgaaaaaaaacgctatgcgaaaatgacgagtataatttcggttttacaggcagggtaatggaggtctctttcggttccgtaaccatccaaaggtcacccatttgatcaaaagcagagccacgaagcattggccctggaactcttgctctcagccactgtgctattcatgagatgaatgcatatgcttcctaaaaagattatgatcacatttatttgtactgccaaggcaataagtccgtcatactttattgacagggggagaaaaataggttactgaacagtttgcacagtatggtcttatttttgttttttagacaaaggtaggtaatatcttacgaaagatccagaaagacatggaacagaaggtgactggtgtttctctgagagagaggcggaggtgacagaagagttgaggtttccatatgtcaatacagtatcaatgtttaattattggaaggttttattttaattatcagataaagaacccgaggggccaagaaattccactgctagtggtggtagagccgagattcagattgagtctgtcctccaaacctgtgcttcttctaacctctctctcgggattttcctcttctgttgccgtgctgcacttgccctctgggattgaacccacaattgtaggcaaccactgcccttgtattactgataaacttgtgcaaacgaatgccattgctcctctatcttatcacttaaaacttctttctggccgggcacggtggctcacgcctgtaatcccagcacttttgggaggccgaggcaggcagatcacctgaagtcaggagttcgagaccagcctggtcaacatggtgaaaccccgtctctactaaaaatacaaaaaaagttagctgggcgtggtggcatgtgcctgtaatcccagctactcgggaggctgaaacaggagaattgctcgaacccaggaggcagagattgcagtgagctgagatcacaccattgcactccagcctgggtgacagggtaagacttcatctcaaaaaaacaaaaaacaaaaaaaccatttttgtcctagacacctaaataacatcctatggctgatggttgtttttgccaattttgcaaagcgtggggtgaattaaagtatcctgcacgtgtgctttctgcagtgcgaccagggtggcctcgtccctcccgcctccttattctgcatgatcagagtagagccctgtttaggaaaagcactgaactgggcattcagagccctgggctccagtcccggcacagccactggctcttcacttctcccctccagacccactttacttccctgtacaattcaggatggtgaaagctctcaagtccttttttttttttttttttttttgagatggagtcttgctctgtcgcccaggctggagtgcagtggtgcagtggtgcagtctcggctcactgcaatctctgcctcctgggttcaagcaattctctgcctcagcctccggagtagctgggattacaggtgtccaccaccacacccggctagttttttgtatttcctgtagagacaggacctcaccatgttggccaggctggttttgaactcctgacctcaagtgatccacctgcctcggcctcccaaagtgctgggattacaggcatgaaccaccgtgcccggccttgtctatcctatttttaaaatgaacatctctagagccatccccggcggttgcagggacagtctgataagtgaactaagtttctatgcataaatgcttgcctctgggcctcctcgctgctgaccggtgtggttttggccgcaggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaaatgcagcttgtgtttttttttattgttccttggtttcccttggattattttgtagtgtcctccccttggtgacatccatggagccgagggtagcaattcaatgcaacctactggaaaaagaactccaagagcaggtgctagagatggtgagtcagtgccctggggactcaacagggacaaggatttcatagcaggacgacgacacaaggatttcatagcaggacgacgacaacaaagcatttcaaagcacagctggagggtctgacataagatcataagatgaggcctctcacctgctgcgtgactggccaccgccgtcagaacggtcctgtgatcctagcactttgggaggctgaggcgggtcacctgaggtcaggagttcgagaccagcttggcgaacatggtgaaaccccgtctctactaaaaatacagaaattagccgggtgtggtggcgggcgcctgtaatcccagctacttgggaggctgagacaggagaattgcttgaacccaggaggcggaggttgcagtgaaccgagatcacaccactgcaccccagcctgggcgatggagcaagaccccgtctcaaaaaataaacaaataaataaaataatggacctctagctgggccctctccaggtgccctggcttcatacccggagtctctggcagacagacatgactcttccatggagaaaccaagagaataataactggccccgagtttatccagtcagtaagccgactgccagagacagtcctcgttctgaagggaagtaaagaggaatgcagaaaggaatgaattctgctcacttgtgaaccctcctaactcttcacaaaaaattgcttacaacttcatagcagatgttcagtatctgtattcactagattcttagcttcccttctccctctgttcaatgactaacgaacaatgtctgtgctcctctctgagagaaaagataacaaggacacagcccccgtcctctggtagtttagaatttacactgtcctcaaagtttttaatccctgcttactaaatcataaaggaattaaacgcaatgggggagggatggggagggagagaggctagaaatcccacaaactgatagctattaccatgcagactaactgtcagcagaaatatttaggcaaatcaaagagataaaatcagtggtcttactctgacacagcagaaacttcccttggatgctctacagaggtttgaacaaggccatctcaggccccacattcagtagcgttagcggcaggtcctgttaggctttgccatctcaggccccacattcagtagcgttagcggcaggtcctgttgggctttgcccttgctatgaccccaccgttccctcctgcactgcgcccagcctagtgtcgtggatgtctctcaggttgccttgaagccttccgggcaagtcccatcagccaacgcaacatcagaccagactctcctgatttcctctccccatcaacaaaacccttctctggggtcctgctgtttcctaatgtgaacactagctaattagacaaatgcatctatctgtggctggtgcactgacggcttctcttgagttaatgcgtcacctctggtatccatcagtgttcttagtctcatgcaactgaagacggttctgtctgatttaagtagcttacgcatttagtaagagaatattagtaagctctggactctcgggaaggctgaggaacaggcttggaaaatgggcaggaacagaagatgctgtgtagcaattgggaccagctggtctcgaactcctgacctcagcccaaaccatgccatgagcagtaactgtgggagcatggctgcagccacccctgccaccttctgctgaaataaatgctccccaaattctgctgcatcgccagctcctgaccgtggtcatgtgcccctgccctgagtacaagaaggactggcacggcaatgctgtaccccttggcgaggtgtctatggcagaagataggctccgtgtcctccaaattcttatgagggggcagagttcttgaaacctaagaaaggaagtgagacgttgagcaaacaaaatgaatgaaaagtaagtcccgtatccttttatggctgcatgtacattttatttatttatttatttatttatttatttatttatttattagcctgagtctcgctttgttgcccaggctggagtgcagtggcgtgatctctgctcactgcaacctctgcctcccaggttcaagcgattctcctgcctcagcctcctgaatagctgggactacaggcgcccgccaccacacccagctaatttttgtatttttagtagagacacggtttcaccatgttggccaggctggtcttgaactcctggcctcagggtgatccgcccactgtggcctcccaaagtgttgggattacaggcgtgagccaccgcgcccaggcagcgtgtacattttagcaggcaacttctggaagcaaattcttagcacaaagaaatgactcaaatgatggaaacttcagacagaaactcagggcagtcggggagatagtttggggttcagcaggacttttgaagcccctcaagtcacaccatgtagctgaccacccactctttctgttcttggggtccagcccgggaggatgacaaattgagccccagccctgcctgtgactgtgactttagaaggctgtgggctttccttcctagtgttttccatcacaaggatccaaaggtgatttcctgccgggtgcggtggctcatgcctataatcccagcactttgggaagctgaggtgggtggatcacctgaggtcaggagttcgagacccgcctggccaatatggtgaaaccccatctctactaaaaatacaaaaattagctgggcgtggtggcgtgtgcctgtagtcccagctactcgggaggctgaggcaggagaatcgcttgaacctgggaggcggaggttgcagtgagcagagatggcgccactgtagtccagcctggtcgacaagacaaaattccgtctcaaaaaaaaaaggatgattttctaggtttctctcagtatgcggaaagttacatagggaaggtgctttctgccttcagtgctcagctatggttcccccagcaaattctgtcccctttccctgcttctcccactccgacctggacccataggagaacctactggcgagggaaggacccacaaagcctgttaccagagttcttcggtggggccagaatggtgtctgcctaagagctcccattcagccaggtggggcaccacgtggttcttcctcagtgggtgggcagtagggggccatttccggttgccacatgccagaatattcacacaggaggatattcagaatcacagataaatcatgtcagagactggtctgtgaacatgagtaacagtaacttagattttggaaatccagtcataaaacaaaagctgaaggtttttctggaggcatttaagttagggatcaattgatttttttccgttctttctttttttgagatggagtcttgctctgtcacccaggctggagtgcaatggcgcaatctcggctcactgcaaactccgcctcccgggttcaagcgattctcctgcctcagcctcctgagtagctgggatgacaggtgcctgccaccacgcccagctaatttttgtatttttagtagagatggggtttcaccatgttggccaggccggcctcgaactcctgaccttgtgatccgcccgcctcggcctcccacagtgctgggatgacaggctgagccacggcgcctgctgatttctttttttaaacgaccccagttgcaagcaattggacaaactctaatccttggtttgtatcactggtcatatcactttttatttatttaatgtgccagataacttccatttgcccctccagatctacttcccactcttttccaccctgccccaggaggctggcctcaatgggctcccttgccctttggcttccagtggtatttggctaagaaggaggtttggcaaatcacaggggaggaagaaagtgaggtcagagtatttattctcctgactcctccctgtagatttgtctcaaactggctgcacctatcaaccaaactcacactcgtctcaaggcggctctttgcacacgaatctctgccttaggtatctaggaaccactcactcccctggctctcttctctgggcctagcatgggtaacagctctgcctcaccagctcgtgtaattgcattatcctttgcggtttgccctcccctctccaccgctttgtgaatcgtccctttgtaaatcctcctgacttgtccttgtttgaacgtgccatctggttcctgctgggtccctgcatgacgcagctggctactcatttagtaatcctgagcccgagagattccagcacttgtgtcagggagccacagagtgctaaggatgcgcggccagcgctaggaaagcaaatctcccgaagatggagtcccctgatttccatggagtccatgcgtggacatgaggaagaaggtggacatgaggaagatggcacgcctcagtgtgttacaaacatattcatattttacccaaattagagtgggagaagtttccagccttggagaccttctttaaaagagtgtgggtgttgcaatgaccaaagcaaacagatgatggagctggggaaaaaaaaagtgttatttaaaaaaatccttctcggccgggtgcagtggctcatgcctataatcccagcactctggaaggctgaagcaggcggatcacctgaggtcaggagtttgagaccagcctgcccaacatggcgaaaccccgtctccactaaaaatacaaaaaattacccggcgtggtggcacatgcctgtaatcccagctactgcgggggctgaggcaggaggatctcttgaacccgggaggcggaggttgcattgagccaagatcgtgccactgcactccagcctgggtgacaagagcgaaactgtgtctcaaaaaaacaaaaacgaaaaacaaaaaaaaacacttctcaccaactagtcatcttctatttcatcctcatcaacaagtaccaagcacttattttgtgctaagtgctttatgtggataatttcgcttaatcttggagaaaactctaggctgagagcgcttaagatttgttcaaggtggctgggcgtgggggctcatgcctgtaatctcagcacttagggaggccatggtgggaggatcacttgagggtaggattttgagaccagcctgggcaacagagcaagaccccatctctacaaaaaaatacaaaaattagtcaggcatggtagcatgcgcctgcaggctcagctactcgagaggctgatcacttgagcccaggaggtggaagctgcagggagccacgatcgcaccatggcactccagcctgggcaatagaatgagaccctctctcaaaaaaaaaaaaaaaaaaaaaaaaaaagatgatttgcccaagaactgtggtgaagatgttaacattacgcaaagaagagcaaacagcatcaacaacttgtcatctttatcaagtctatcagactgtcagccgatagtggttagtggctgcggaacagcacgtttgctaatgaaatggcagacgtggagaaggttcgtatggggtacaggtgacgaagcacatagtgatggaagatcactcacttccactgagactgttcaaaggcagcagcatgatgcagtgatagcttggaggtaattaacaacagaggaaccttactcaattccttcctccttcagccaagcaacatcttcctgctgaacagtcaggatcaaaggctgatgtagggggaccctggttttcaccatgattttaatggttcatggtgggtgtgggcactgattaggaaaaccatcttgccagggaggaaactgtttctgagataatcacctgatccaaatttttcaaacgtagaacccaattatagatgtcatttctctgggcctaggcaaagactgggcacagtggctcatgcctgtaatcccagcactttgggaggccgaggtgggtggatcacctgaggtcaggagttcgagaccagtctgaccaatatggtgaaaccccatctctactaaaaatacgaaaattagctaggcttggtggcgtgcccctgtagtcccagctactcgggaagctgagacaggataattgcttgaacctgggagacggaggttgcagtgagcagagatcatgccactgcactccagcctgggcgacagagcaagactgcgtcaaaaaaaaaaagagagagagagagaaagaaaaagaaagaaataaaagaaagaaagaaagaaggaaagaaagagaaagagagagagagagaaatgaaggaaggaaggaatgaaggaaggaaggaagaaaagcagaaagaaagattaggctaaataccaagatggactactcattcagagacttagtagttgttgaagcattgattcattcactccaggaccttgagagctcaagcagttggttcttgttctcagctttaccaagaatggtaggtggtggaaggatgagagccagctaaaccccaggaaagactggaagaggaggatcacaaggcacagaccttgactccccaaggagtcactctcaaattatacttctcagggctccttaaaaatggtcttctttaaggctgaggcaggtggattgcctgcggtcaggagttcgagacccgcctaggcaacatggtgaaacccccgtctctactaaaaatacaaaaattagccaggcgtggtggcgggctcctgtagtcccaactactaggaaggctgaggcatgagaattgcttgaactcgggaggcggaggttgcagtgagccgagagatcacgccattgcaccccagcctgggtgacagagtgagactcttgtctccaaaaaaaaaaaaagggtcctctgtaattggtcccaagagcctctgtgactttcactcattcgggacacggcttttgttcaaggtcccatcttcctcccagtgcaatcggtgcaatgactgtcctcagcagctttttggaccttctgtccaaagttggttctgtcgaaggacagtcaaactctggaaaaaaattaaaaaaaaaaaaaaaaaaaaaaaaatatatatatatatatatatatatatatatatatttttttttttttttttttttttttgagacagagtcttgctctgtcccccaggctggagtgcagttgcacgatctcggctcactgcaacctctgcctctggtgttcgatcaattctctgcctcagtctcccgagtagctggcattacagatgccagccaccatgcctggctaatttttgtatttttagtagagatggggtttcaccatgttggccaggcttgtttcgcactcctgacctcaggtgatccacttgcctcggcctcccaatgtgctggggattacaggtgtgagccaccatgtctggccagaactctataaaatatttgaagagacttatagaactctgtaaaatacttgaagagatttattctgagccaaatacgagtgaccatggcccatgacaagtcctgagaacgtgtgccgaaggtggtcagggcacggcttggttttatacattttagagaggcaggagacttcaatcaaatacatttaagaaatgcattgcagccaggcacggtggctcacgcctgtaatcccagcattctaggaggctgaggcaggcggatcacaaggtcaagagatcgagaccatcctggccaacatggtgaaaccccgtctctactaaaaatacaaaaattagctgggcgtggtggggcacacctgtaatcccacctactcgggaggctgaggcaggagaattgcttgaacccaagaggcagaggttgttgtgagctgagatcctgccactgcactccagcctggctgacagagttagactccatgtcaagaaaaattaaaaaaattaaaaacttgcatcatatttaaaactcttaaccctgtacacactgagtttgcaaccagtattccctccctttgcttctttcaagggtgtttagcttataaatggcaacacagcaaaccattttacatataagaacatgcagagcaattctgacactaagtgagtctgtgtctcagtgactgattaaccctgattgatttgattgattaacccttagtaactttacataacagcatcttatcttgctgagactgagagaagtttcttgcatcatctcataatcttaagagagatggtattggcagatcacagttcaaaaccagtcttcccacagacctccaaaacctttgtctaggagaacatgggaaggtacacatacagccacatcaaatctcagtggggataaagctggcatggacactgcgggggcctgcacactgctaccccagtggggcctcccagtcattgagggagaagtggggccggcatggggagggcagagagagcaaggaggagggggagaggtcatgctctggaagatgggtgtgtgctctcttttccggctactgttttcagtgtggtaagcaaatcccttcagctgaatgccctggagaggaagcccagtgcttcctgttgtcttaccaacgctgtaaaatgcaagttagaaataaagcaaaaagggggaaaggggaaaaaaatgggaagctctcctggctagatcggaacgccagcctttaggaggaaactcagctcacttcttttccccggagatgcagaggaagaggcacacctcacatgtgagttgtttctcaaatcaatcaggattcagaaaataatctctctatataaaaagggcatttttggccgggctcggtggctcaagcctgtaacccttgcactttgggaggctgaggtgggaggatcacctgaggtcaagagtttgagaccagcctggccaacatggtgaaaccccatctctactaaaaacacaaaaatcagccgagtgtggtggtgcacacctgtggtcccagctactcgggaggctgaggcaggataatcgctggaactcgggaggcagaggttgtagtgatcagagatcgcaccactgcactccagcctgagtgacagagcaagattctgtctcaaaaaaaaaaaaaaaaaaaagaaagaaagaaagaaaaagaaaaagaaaagacaagaaaaacagcagaataaacaacagagttgaaagtcctaaaaggatgactaaggagatatgtgtatgagatacagccaaagaaatacacccaccccctgtttaatgccctcaaaatccttccattctgtgagaatctaccccaagggtttgtagtgttggaaagaatcatttaaatatcagattttgtttgattgctttgctgctctgagcatcttagctgcctatgagatacttcatgagatgtagcagaaacatcctggcccccagggtagagtacacaggcagtcctgacaggtcacccggtattcatatacttatttatttatatcaccatcattaatatacatacattcatttatttttaacattaccatacagcttaccacttacgaaaatagcctctctttggctggcatttcactgacaaacttttttcttctattttcaaaaagccaatatagctccattcaaattttatttggccatttgccttccccacacccccttcttagataatgtctttgagaaatctgtgcgaaggactgtgtttaaaccgtcttctgctaatgacacctctcctgaaattttcagattatacaagaaacttctcttaaaagtttcaagcgaaccctgactttcttgatctagatttcttgaacaatatcatcttcctctactgcctgtgtttcactttgtagaacatccttcctctgaaagagcgataacaacaacaaaaattccactttgatcgtaacagtcgattagaaaaggaaatgcccttcaattctctaacttttcaaaaatgtcacatgctttcggccgggtgcagtggctcacgcctgtaatcccagcactttgggaggctgagacgggcggatcacgaggtcaggagatcgagaccatcctggctaacatggtgaaaccccgtccctactaaaaaatacaaaaaattagccgggcgtggtggtggatgcctgtaatcccagctactcgggaggctgaagcaggagaatggcgtgaacccgggaggcggagcttgcagtgagccgagatcgcgccactgcgctccagcctgggcgacaaagtgagactcgtttctcaaaaaaaaaaaaaaaaaaaaaaaaaaaaagtcatgctttccttttgaatgcaagtcagtgttgcctccccagctccgcttcctacagttgtcctaacaggaaactaatttttcttcttttatttctttatggccactgtcctgatttaatttattatttttaacttttgtgggtacagaaaagtgtatttatttatggggtacatgagatattttgatacgggtacacaatgtataataatcacatcagggtaaatggggtacccattacctcaagcatttatcttttctttgtgttacaaacaatccaaatatactcctttaggtatttaaaaatatacagtaaattactgttgactgtagtcactctattttgctattaaatactagattttattcattcattcttttttttcccctgagacagggtctcgctctgtcatccaggctgaagcacagtggccggatctcggctcactgccttctcaacttcctcggctcaaatgattctcccacctcagcctcctgggtactgggattacaggcgtgcaccagcacgcccggctaatattttttatttatttttatttttttcaagacgaagtctcactctgtcgcccaggctggagtgcagtggctcaatccggactcactgcaacctccgcctcctgggttcaagcgattcccctgcctcagtctcacgagtagctgggattacaggtgcccgccaccatgtcaggctcatttttgtatttttagtaaagaaaaggtttcaccatgttggccaggctggtcttaaactcccaaccgcaggcaatctgcccacctcggcctcccaaagtgctgggattacaggcgttagccacggagcccggccattttttaaattttttgtagagatggcgtctcactatgttgcccaggatggtcttgaacttctaggctcaatcattctcccaaattggcttcccacagcgctagtagcataagcccctgcacccagcccattgtttctttttctctcttttttttttttttgagacagagtttttctcctgttgctcaggctggaaggcaatggcgcgatcttggctcactgcaaccactgcctcccaggttcaaacgattctcctgcctcagcctcccgagtagctgggatgacaggcatgcgccaccgtgcctggctaattttgtatttttagtagaaatggggtttcaccatgttggtcaggctggtctcaaattcctgacctcatgtgatcagcccacctcggcttcccaaagtgctgggattgcaggtgtgagccaccgcgcctgctccattgtttgtaactgtatttttgtacccattaactatcccagttctctctgaccaatcaccctttccagcctctggaaaccatcattctactctatatctccggggattcaactgttttactatttttagctcccacaaataaatgaaaacgtgaagtttgtctttttgtacttggcttatttgacttaacacaatgacctccagttccatccatactgtggcaaatgacaggatctcattctttttcttggctgaatagtactccattgtctatatggaccagtttctttatccattcatcttttgatggatacttaggttgcttccaaatcttggctattgtgaatagtgctgcaataaacatgggagggcaggtatctcttcgatatacagatttcctttcttttgggtatatacctagcagtgggattgatggatcagatgctagctctatttttagtttttgtttgtgtgttttgagacagggtctcaccctgtcgcccaggctagagtgcagtggcatgagctcggctccctgcagcctgaaactcccgtgctcaagcgatcctctcacctcagcctcccaagtaggtgggactacaggcatccgctaccatgccctgctaattttttgtatattttgtatatatatatgtatatgtatatgtatatatgtatatatagagaacgagcgatggagtttcgatcttgtttccctggctggagtgcaatggcatgacctcggctcattgcaacctccgcctcccgagttcaagtgattctcctgcctcagcctcctgaggagctgggattacaggcatgcgccaccctgcccggctaattttgtatttttagtagagatggggtttcaccacgttggtcaggctggtcttgaactcctgatctcaggtgatccgcccacctcggcctcccaaagtgctgggattacaggcatgagccactgcactcggccccaaatacttttttttaaaagttacgtttaaaaataaaagaactctttgcataacgcatgtgttcacaaataagaaagtggcatatattaattcagtggctgaaatataattctgcgtatgaaagtacaaagtcttttttaaaatgtgctttatttacttttgattgctagtgcttctactgaggctctcatggtgggcgcagttctgcagctattcacctttctatgggtattttgggtctcccactctcctccctgtcaaccctgctccagcacccagcaggtaggacatccttgttcatactttcaaagtttatttagaccaacagtgaaatactttaacaactcagtttttttttctttcgatggctattaactctagtagtctcctctttttggcatttaaaatcttataaataggcacaatttgtttctcaggcttcaaaggaagaaaagagctgatacttgcttgagcagctcagcctctggtgactgccatcaaattccattagcccatcattgaatttatcgtcttttcccttcctgacttatttaatcttttttttctcccaatttgtacccactcagtcctttttcatttcattttcaagtgtccttcttgggtgtatttttgtgagttcatgaacaaattttacttcttttggggggcttagttttccagtgttgatttcttagcttgtgaatctctccacagtccttgcaaaatgttgtacttactggccgggcgcggtggctcccgcctgtaatcgcagcactttgggaggccgaggcgggcggatcacgaggtcaggagatcgagaccatcctggctaacacggtgaaaccccgtctctactaaaaatacaaaaaattagccgggcatgttggcacgcgcctgtagtcccggccactcgggaggctgaggcaggagaatggcgggaacccgggaggcagagcttgcagtgagccgagatcgcaccactgcactccagcctgggcgacagagcaagactccgtctcaaaaaaaaaaaaaaaagtttcacttactgttgtttacttttgtagtttgtggggttttttgcttgtttgtttgcttgttttgagacggagtcttcttccgtcaccaggctggaatccagtggcgcgatctcggctcactgcaagctccgcctcccgggttcccgccattctcctgcctcagcctcccgagtggccgggactacaggcgcccgccaccgcgcccggctaattttttgtatttttagtagagacggggtttcaccatgttgaccagcctcgtcttgaactcctgacctcaggtgatccgcccacctcggcctcccaaagtgctgggatgacaggcgtgagccaccacctggccgagtttgcggttttcatcactcagtcacttgaggagctgtattcccggcgcgtggtatccaagatggcgaccgccacggcttctttgttaagccttaagcggtacctgggttttgatgttgtgaggtttgttcattctcagagggcattttaatgttgcgttactactatgttgccatgttactgggattcaatgttaaattctagatcctgtttaatttttggtagtagatgacagggctcatcaccttttttgagatgatggagtatagcctactttgggaacttgtatcaagagagggagggttgctggttgaatggtatcaatcctttaagtcatcgccagttcacaatttctatcttcctgtggaacatactgtttttcccaatcccaagaagccttttgctagatacatgatttttaaaaatcaacgttttttgttttttttttgagacggagtcttgctctgtcgcccaggctggagtgcagtggcgcgatctcggctcactgcaagctccgcctcccgggtccaagtgattctcctgcctcagcctcccaagtagctggaactacaggcgcccatcaccacgcccggctaattttttgtgtttttagtagagacggggtttcgccatgttagccaggatggtctcgatctcctgacctcgtgatttgcctgccttggcctcccaaagtgctgggattacaggcgggagccaccgcgcccggccccgtttttattttttattgttgttaagttttccactgtcagttcctgagcttccgcaggtggaaaggtaggtcagcctgcggtctggctgttgcatccactctgaggttactcaaggtggaggagcagcaccagaataacagagatggctttctactgggcgttagcactgaggttacagtcctaggttgactctaacgaaacatgcccttgagctaagcattgccctcctgggcttcactttcctcacctacaaaataaggaggttgaactagataatttctactgtttcctgcaagtctaatgttctgtgattctaagagctttctgttagattatctgagtgaattagacagatattagaaatatttataaataaaatatcgattgtaaataaaattagaaagagtgggaggggtcagcttagttaagaaagggagcaatgtggaggtgtttggtttgcccgtggcccagaggtgatgaggaagcagccttcccttcctgtccccacaacctttatctgattgtttataactgtgagcttccagtctgtgagaacacctatgtggattttgtttgttatcactgagggtttcagctaactcatagccacaaagtcattggactattggacttagagggctattgagccctctaagatgggtatgtctcagctctctttctcatccaggtgccagcacctacctgtgagatactgaccaggaatctctttcctaacacccctaaaataggctggaatctgccccccacccctcaagccagctgacagcaacatcaggacaagtttagatgtttctaagctgacaaagggcactctgcttgggaactgcccactggtttcttggtatcaataaactagagcttcaccacccacccccacatcctcaaatctgatgtcctaatcagggaattacagctcggtcttcccttatgatttcaacatcataaaccttttaggtctgttcacttctagaaagatgcatttatttgcttgaggcttatttaaagtccaaatacacagaaatcttactccttgtttgagcaaatccctaagacattcatttattcagcaaatatttaccaagctgctgctctgtgccaggcactgcttagctctggggatacatacaaagctatatttttaattcattggttgtcacttacaagttacttttcttcacttccatcccccatccctccactgttcttgactcccccaagtatcctgagagctgagtgctgaactactcccgtcagcactgggtcaaggttctctgtgctgcatttggacaatgacaagaagggtgtgtggcatatgtatcatataagctgttttctgtgtcttcatttttcttaatttaatgtgctcctgaaagaggaatcagtttctcttcctgtgtcacccatgcatttgccacatactataacacaataggccatttctgttcttagtctcaaagctggatgacacagaacatcagtttgccacatatctaatcatccaacagacacattagtccagactctgggctcagaatctcaaagaaactagaaaacaagtaatattggcttagccctagtgccagtcagttgcctctttactttcagatcccttctccaccctttcctgttttgctctgtatccatccatactgatataaataaatgtctaaataaattaataagtgggaaagaagaattataaataatgtgtgtagattctttccattctaggaagtgaatcttatcctcctctgctgccctccctcaactttggagtgtggttggacttagtgatgtacttccaaaaaataaaatatggagaggcaaaaatagtaacgtcacagtaaagcaacctggcagatactacttgaaccgagtgatgaaggttaacatcaccaatggtgtcatgcaagtagtatgtaccccttgatacgatgtgatgagaacggcacatcacctctggtattccttccaataacccatcaccccagtcctataatgagaaaaatacaagacaacccaatctgaaatacattctacaaaatatctgaccagtcctcttcaaaactatcaaggtcatgaaacacaaggaaagcctaagaaagtaataactaatcacaatacagtattctggattggatcctggaagaaacaaagatcactaatgaaaatatctggtgaactatgagtaaagtctggagtttattaatagcaatgtatcaatgttgttttcttagttttgacaaatgtattggataaacaaattgggtgagaggtatatggaaacgttttgtagtatcttcagaacttttctgtgactctgaaattattctaaaacaaaaaaattttagtaaactctcaagaggaaaaaaatgaattaccaatgtcaggaattaaaatgagaatattgctacagaccctacaacaatagaagataatacgatgttgtaactatctttgcacaataatttgaataatttagatgaaatcagcagaggctttggaaaatacaagtaaataaatatgagatgagaagaaagaataaaatctgaatagtcctgtaggttagatttgtaattaaaaccgttctacaaagaaaactccatgtccagatggctttactagtgaatgactcaaaatattgaagaaagaaaaatattaatattcttcagaaattttttaaaacgatagaggttcatgaccaacatggtgaaacgccatctctcctaaaaatacaaaaattagctaggtatggtggctcatgcctataatcccagctactcggaaggctgaggtaggagaattgcttgaacctgggagacggaggttgcagtgagctgagatcgcgccactgcactccagcctgggcgacagagcaagactctgtctcaaaaaagaaaaaaaaaaggaaaagttaatatattccaacatgttttatgaggtgggcaaaatcctgatatcgagactcaaaaccagacattgcaaaaagagaaaattgttggacgacctctttaatgagcttggatataaatattctcaacaaaatattaacaaagcaaatctggcaatataccccaaaaagacttcacaccttgctcagtaatgccaggtttattctagtaatgcaagattagtataacatttgaaagtcaatcaacacaaattttacatgaacagactaaaagaataatcatgtaatcatctcaatatgcaaaaaagcacctgaaaaaattcaatacctgttaatgtaataacactcaggaaaccaataatagaagattttttaattcattaaatagtatccatctgtgccaggtgcggtggctcatacctgtaatcccagcactttgggaggctgaggcaggtggatcatgaggtcaggagttcaagagcagcctgaccaagatggtgaaactctgtctctactaaaaatacaaaaattagtcgggcgtggtggggggcacctgtaatcccagctactcaggaggctgaggcaggagaatcacttgaacccaggaggcagaggttgcagtgagccaagatcatgccactgaactccagcctgggcaacagagcaagactccatctcaaataataataataaaatagtatccacctgcaaaaggtttttgcgaaatactgcaaaaatagtatccatctgcaaaaagcactttttgcagaacttttctgtgactctgaacttttctgtgactctgaaattattctaaaacacaagaacattttaattaggtataggtatcatcaaactgaatgctgaaatattgaatacttccccctgacatcagaaacatggtaatgatatgtaccatcaccaccaatacccaacagtgtactggaggttctagccattactgtcaagaaagggggggaaggaataaaaactggaaagcaaaatacctgtcattattcacaaatgacgtgacgacatacatagaaagtctgaaagaatctgcaaataaatgatgcgatttcacagatgaatttagcacagttgctagaaggaaggtcagtatacaaaaaccaactgtatttgtacatgcttctacaatcaactagaaaataaaaatctttaagacaccatttatactaacacccagcaattccattcctagtacttatccaaggaaaatgaatcccccaaaagacatgtacacacttttagcagctttatcacagtaataaaaaactgacaaccacctaaaagcccatccacagagggctgaatcaccaaactgtaatatattcatatatagaaataccacacagcaatacaaaagagaaagtaccattttatgccacagagtcaatgaatctcactgccccacgttgagcagagaaaccagatgccaaaaagtatatactgtttttgttttgtttttgtcttattagtagagacggggtttcagcatcttggccaggctggtcttgaactcctgacctcatgatccacccgcctcggcctcccaaagtgctgggattacaagcgtgagccaccgcgcctggccaagtatatactgttttattcaattacattcaagatgacgaaagcaatctaaggtggtagaagttacagtggttcacccttttgggggtttggtattgacaaggaaggggatgaggcagccttttggaggtgctggagacgtgtgctggtgcccacaggggtgtacatctgtgtcaacgttcattgaactgtacacttcaaattgatgcactttgctgtacgtccgttaaataaaaatgactatggaataatcgcaaccaatctagacaatgataatactgtagacagcatatgacgaaagcctggtccaaagcacctgaggagggggatcgtaatgtctgagactgactcttcaggacttagaatctccttagaaagaaagataagtgtaaaagttaccaccctataatgatgacatagattttttttctttgcaattttatctttttttttttttttttgagatggagtttcactgttgttgcccaggctggagtgcaatggcacaatctcggctcaccgcaacctccgcctcccaggttcaaacgattctcctgcctcagcttcctgagtatctgggattacaggcatgcaccaccacgcctggctaattttgtatttttagtagagacggagtttcaccatgttggtcaggctcaaactcccgacctcagatgattcgcccacctcagcctcccaaagtgctgggattacaggtgtgagccaccgtgcccagcccttatattttaaaggatattgttgttttacgcattttgtatcagtcgttttcaaaaagtgaattgcctatgtgttactatctagcttggaaaaacttgcaggtctctttagcaaacacacattgtgtggaaaacacgctactctctgtgagaaagccagaaaggagcctcaggaaatgaacctgtaaattaaagaaaggagggagatgtttcctccagctagtgggaaacctggagagaggacagaggtgactcttccccaactcccacacctggacttttccctcacggaggaaggaaggagatgcaggtatatttgctggagggattttctctgaagtgggatgtaaacaaaatactgtgaaaccaacttaaggcaatttgtccgtttataatcgttggtagataacagatgaggtccacagatgtcctgacccaaacatcatggcatgatggaagcaagtctcagcccagacagagccatatgcacatcatgtttactatcaggcaggtacaggaacagttttcaaatgtgttctgtgtacttgacgaagccccagatctccgaccttttcggtactactccatttcacttgacacaaatgaaacgctagtctccagtgaggatccagctagcctcttgtcaaactcaaagggccaagactatttttttttgaaacagagtcttgctctgttgtccaggctggagtgcaatggcatgatctcggctcactgcaacctccaccttccaggttcaagcgattctcctgcctcagcctcccgagtagctgggattacaggtgcacaccaccactcctggctaattttttttgtattttcagtagagacagggtttctccatgttggtcaggccggtctcgaactcccgaccttgggtgatctgcccgcctcggcttcccgaagtgctgagattacaggcatgagccactgtgcccagcccagaaaggttttcttttcttttctttttctttttttttttttttttgagacagagtctccctctgtcacccaggctgcagtgcagtggcacgatctcggctcactgcaacctctgctaccaggggacctgccccgataatcacgtacgttcttttctcgtttccctaagcgtccgccggcttgagaaataaagggacagagtacaaaagagagaaattttaaagccgggcatctggggaagacatcacatgtcggtaggttccgtgatgccccacaagccacaaaaaccagcaagtttttattagggattttcaaaaggggagggagtgtgcgaataggtgtgggtcacagacatcaagtatttaacagggtaatagaatatcacaaggcaagtggaggaagggcgagatcacaggaccacaggaccaaagtgaaattaaaattgctaatgaagtttcgggcaccattgtcattgataacatcttatcaggagacaggcttttgagatcaactggtctgaccaaaatttattaggcgggaatttcctcttcctaataagcctgagagcgctatgggagactggagtttatttcatccctacagtctcgaccatagaagatggccacacctaagggggccacaccgaagggggccatttatagacccaccctcaggggtgcattctctttctcagggatgtcccatgctgagaaaaagaattcagcgatatttctgccatttgcttttgaaagaagagaaatatggctgtgttctgccctgctcacatgtggtcagagtttaaggttatctctcttgttccctgaacaattgctgttatcctgttcttttttcaaggtgcccacatttcatattgctcaaacacacatgctgtacaatttgtgcagttaatgcaattattacagggtcctgaggtgacatacatcctcctcagctgacaggattaagagattaaagtaaagacaggcataggaaatcacaagggtattgattggggaagtgataagtgtccatgaaatcttcacaatttatgtttagagattgcagtaaagataggcataagaaattacaaaagtattaatttggggaactaataaatgtccataaaatcttcacaatccacgttcttctgtcatggcttcagctggtgacttcctgcaacactccgcctcccgggttcaagtgattctcctgcctcagcctccccagtagctgggactacaggcacccgccaccacacccggctaattttttgtattttcagtagagatggggtttcaccatgttggccaggctggtctcgatctcctgacctcatgatccacccgtctcggcctcccaaagtgctgggattacaggcttgagccaccgcgcctggccaaggttttcttaatggagggacataaagtcgatattagtcgaaaggggcaagtccccctcttttacaatggacacagagctgaaaagactatgagtgacaaaaactggtgataagtgaaacacaaaacaggaaaatagaaggagttacagtaacattgtttgaagtgttttgtttttgtttgagacggagtcttgctctgtcacccaggctggagtgcagtggtgcgatctcggctcactgcaacctccatctcccgggttcaagcgattctcctgcctcagcctcctgagtggctgggattacaggtgttcaccacaatgcccgtatttttgtatttttagtagagatggggtttcaccacggtggccaggttggtctcgaactcctgacctcaggtgatccgcctgcctcggccttccaaagtgttgtgatcacaggcgtgagccaccgcgcctggcctgtttgaagttttcttaatgtattgcatttaatcaaagaggattgtaaaatgtttttaaactcaggtgagctctgaaagtgcctagtccttgtatttacccaaaccagtgtttaactcctgccactgccactcacaaaatgctggattgcctaccacttacttcactctgctccttggtttcttaatctgtataataggatcagaaattcttctgtgaggaaattcggaaaggaaaacccaaacgtagcagagacaatggacattggcacccttctgccccctggtggtaatttttagaaccatgtgggcagtggcgaggctaaaaataaaatgtgcaaagtgtaaaacaaaaaccacgcagtgtcttccttgtcatgcacagccgcgttcgaatcgctcattgtcttgcctcctcagtgctttctcccgcccacgactatcagtggtccaaccacacattgcaggaagttccaggagtcatccacttaccctagagcaagcttgtcccacctgctgcccgcgggctgcatgtggcccaggtggctttgaatgcagcccaacacaaattgataagcttttttttgtgactttttttttttttagttcatcagctatcattagtgttagtgtattttttaatgtatggcccaagacaattcttcttttaatgtggggagaaaaaagattggacacccctaccctagaggaatgatagtgtttagtatttgttttcattcttattttccttctcctctatatcgcatggattgtggagcgtgtccatgtcttcaggtcatcagcatgacttttaggggaggtgactacagagtcaaagccatgggagatgcggaattcagctgaagatcacttaaacatccagcaccgctgtagcactagtcatagaaagaatatgaagagaattcaagattaaacagattggccaggcgcggtggctcaggcctgtaatcccagcactttgggaggccgaggcaggcggatcacctgaggtcaggagttagaaaccagcctggccaacatggtgaaacccatctctattaaaagtacaaaaaatttagccgggtgtggtggcacatgcctgtaatcccagctactcgggaggctgaggcaggagaatcgcttgaacccgggaggcagaggttgcagtgagccgagattgtgccactgcactccagcctggacgacagatcaagactctgtctggaaaaaaaaaaaaaaaagattgagcaaagcagtcaatagattaattggatttaattaagtgatgaaagaattgagtaatggaacttcacccattctaaccatgtgataaagtagaaaaggttcaaagatttagtaggggtttaaaatgagtttaagagaatgggattacaattccaatcccattggtaagacaaattttatttctaaaaattcatgtatttcccccctttatacaactgcaaatgcgagtttggagctagagtgggagaggaaagcaaagaatgaagggaaagaaataggaggaagattctagaaatgggggcagcatgggagaagtggtgggagcaaagtcctggcatatagatgccacaatcaaaacttctgccctgtttcctagctgcttggtgtcagcactggggccattcccccagcctgtgaccttggcatcccctatgttgacctgggctcttcctctgtccttccacctggatgtcctttagtgggtcctggccagggtcctattgctccctttaacctctggagcttttgtctgctacattttcttacactgatgctgactcagacctaatgctgggtgaagttgtgatgtggctgaagtgtctgggtgtaattcaagaatcctcgagggagaatcaggagttttgggttccggttccaacttggtaatttaccaagtcacagcctcctggagcctggttttccctatcaataaaatgaagaaatctgtcttctctagttcataagttgtcaagatcaaatgtgtaaatacataggaagttcttaggaaagggaaggcttctatcactgtaaagaagtatcattgataactagtatatgatagtctgctgccgtctgccttccccatatgtaccctatcatgctctgagtccctccttcctgccttttccccatctcttatcacaacctgctttttgtatgtgattgctatttacaccttgataatattaaatcagagatatacacaattaaatttgagatagttacgccttgtccagaaatattcacatattaagcttgatcgctatttgggtggtaaaaagttagtccttgttcaagaaatgttaaccaacagtttggggtaggagggagaagtgaggctttccttgtgttctgaaatcactatatttcatgcctgaattagcctgtctgagctggaattcagagtgaatctttggatccatgttttaaagggacaactatagagactcccattgctttttctatgcacatagtttttgtgcggtttttactggaatcttattacagttacagttaccatcccatggaccaacatggtccatcgagggccttgcagtgagagggtcagtccatagatgctggagccacatgacgtgggttcaaatttcaactctcccacttattagtgtgtgaccttggacaggctgcttcactgctccggccctcagttttctaatttgcaaaatgggggagattaataatacctatctccagaggtttgttgggaggattaaataataggcctaaaacacctagagcagtgtctggcactgagtacacattagctggaatttatttcaattgcatgtttgaaaaaatttaaaccattcagaaatttaattttaaaaataaaaaatgaaaagtcacttaagctctctatctcccactttaaccccactcctctttccacaggcaaactgttaacagtcactttgcacacatcattcaagagttttgttttgtttttgtttttgttttgagactgagttttgctcttgttgcccaggctggagtgcaatggtgtgatctcggctcactgcaacctctgcctcccaggctcaagcgattctcctgcctcagcctcccgagtagctgggattaaaggcatgcgccaccacgcccggctaaattttgtatttttagtagagatggggtttctacatgttggttaggctggtctcaaactcctgccctcaggtgatccgcccgcctcggcctcccaaagtcctgggatcacaggtgtgagccactgcacctggcctcattcaagagtttttactgatatattttttaaatcaaagaattataatatactatttggcaacttgttttcctcacttaaccatgtagctaggagttatttccaggtcactatgcccagtgctaccttcttctgcctaagggtttcatagtatgccgcagcatggacactgcgcaattcacttaaccaatgtcttattgatggatatttggagtgtttccagttttcgatatttggagtgtttccagttttccacgatcatattcgctttttgcacattcttttctctttataattcagaaccatcaagctgaagcccagcagggcttcctcatttcatcatcatagctcatttcctattgagcaaagcttcttcctcgggtcagctcttgccacacttctttctacagaaacaagaagtggagttatctgtcctgggcttcgggagtgaacacacccattcccacgctgctgctgcccacgctgctttgcccacacagcaccactgtccctggggatcctgaataacaatctgctgagcaaaatcaacatccctttggctacagcgaggctaattgcacttaataggttgtaagagttctggtacagacaggctccttcccatgatgtatttcaccacctcattgaagagatgtgtgttccagtgagagtctgttcctccgtgtcatcccaacaaatgctcctatgtccaggagccattgtcaggaatgctcgttcctctcccttctacacagacaaatctccctttgaggacacactcaactccaactccttttgtgaagctttccctgttgctccagcctgcatgaatccttccctccgccgaatttcttcagcaagaatgccttctaggccaggcacggtggctcatgcctgtaatcccagcactttgggaggccgaggcgggcagatcacctgaggtcgggagttcgagaccagcctgaccaacatggagaaaccctgtctctactaaaatacaaaattagctgggtgtggtggtgtgtgcctataatcctagctactcaggaggctgaggcaggagaatcacttgaacccgggaggcggaggcggaggttgtggtgagctgagatggcgccactgcactccagcctgggcaacaagagcgaaactccatctgaaaaaaaaaaaaaaaaaaaaaaaaagaatgccttctaagtgcatagcacctgtgtgagggtgaaaccctggcccacagagccagtggtcgtaggatagttaaaatagaaggccacagtatattgggaggccaaggcgggcggatcacgaggtcaggagatcgagaccatcctggctaacatggtgaaaccccgtctctactaaaaatacaagaaattagccgggcgtggtggcgggcgcctgtagtcccagctactcgggaggctgaggcaggagaatggcgtgaacctgggaggcggggcttgcagtgagcagagatcgtgccactgcactccagcctgggcgacagagcaagactccgtctcaaaaaaaaaaaaaaaaaggccatagtatatcagaattccatagaaataagattattacaaaaagcctataagcagagagacactggaatatactgaagctagtatgagcaaaagggaattgtgggttggaacaccaatacccacagcaacagtgaaggaaagcaaaagcctcgcacagcgcttctcaaagtgtggtctgggggcttgttagaaatgcaatttcttggccaggcgcagtggctcacacctgtaatcccagcactttgggaggccaaggcaggcggatcacctgaggtcaggagttcaagaccagcctggccaacacggcaaaaccctgtccctactaaaaatataaaaattagccaggcgtggtggcacacgtctgtaatcccagctactcaggaggctgagacaggataattgcttaaacctgggaggtgggagttgcagtgagctgagattgcgccactgcactccaggctgggtgacaagagcgagactctatctcaaacaaattaaaaaaagaaaaaggaaaataaatgcaaattcttaggctccaccccagacttactgaatcagaaattctgggggtggaacgcagcaatctgcgctatcgtgagtcccacagatgagtctggtgcatgctgaagtctaagaaccactagcttgagtagagattcaaagtttgggtctctagcacagaaagacttttgcaacaacgagtctcgggaggcgtaaagcaagcagagaggactgcagctgttaaaagtagtcctaagaagattctaggtaggagaactcaagcgtggggagctgggaaaccccagctggcagggaggggtcctacctggcgagctgccccccaagggcctgcgctggtcaagtgtctcccgaagggtctgcctgcgggcaggagaaacacaggtgtccaggactagtgttctgactgatacgtggccctaggatttctctcctgggaccacttggagaggcaacccttggctgccagaggaagagactgatggaggcagcaggacgggaggaaggcctgtgggaggagggtgccagagtgggaagggagcatgtgaggagagtcttgatggttaatgccaattacctctagaaaattaccaggctttacagactcaagagctactacccaaaagattgaaaaaactgccttaaaaaaaaaaaaagcaacccaccccagggaagagagagagctatttagaaaactccagaagtaaataagctcagacaaatctgagatttatctggtctctgctcctgagtcctgtctgagaatcaggcacctaagagacggggtgttgtgtccaccagagacggtggagaggccgggcacggtggctcacacctgtaatcccagcacttcgggaggccgaggtgggcagatcacctgaggtcaggagttcaagaccagcctggccaaggtggtgagactctgtctcttctaaaaatacaaaaattagccagacttggtggcgcacacctgtaatcccagctactcgggaggctgaggcaggagaatcgcttgaacccgggaggcagaggatgcagtaagccaagatcacgccattgcactccagcctgggtgacagagcgagactccatctcaaaaaagaaaagagatagcgaagaaagccatcatctctggtggtttgcaggtttgattttcatagcagaacccttaatgaagatctcaagtagaactctgaaatgggaaaaacttcaacatgtaagaattgagctgctgtggataaattaggagtccagttcccacctccttattctttttatcactcagaacaatgaccacttttacacccgaccccaaccctagctccccaggatgctgctccacagaaggcagcttgaaaaacgccaatggttaacctctctggtgccttgctgggctgctgtagggacagcggggtcactgcttcacaaagtcacccttcccgttgctggcggttttgatcttcagagagttctgtcttttcttttttcttcttcttctttttttttttttttctgaggcggagttttatgcttttcccccaggctagagtgtgcaatggcgtgatctgggcttgctgcaacctctgtctcctgggttcaagtgattctcctgcctcagcctcccgagtaactggaattacaggtgcacacaaccacgcccagctaatttttggatttttagtagagacggggtttcaccatgttggccaggctagtctcgaactcctgacctcaagtgatccaccctccttggcctcccaaagtgctgagattacaggcgtgagccaccgcgcctggccagaaagttctgtcttttcttgaggtgagagctgctccctaaatttccaatcactgtgcctagtttttccctctagaagtagtaatatattcttctacgtgaaagatctgtaaagaactaaagagctttaagagcaatcttttaacttttgccttttccaggcaaaaatctcatcacttcttgcaaaggattctcatgtgacatggtcactctctgtgggacacactccagtttgtcaacatcttttaaaatgaggctcctggaagaaaacatggctccagacaggatctgatcaggacctttcccccatctgagcactaaccctcaattaatgtagcgtaggcttacattagctttctgggcagccagtccacagagtgttcatactgcgactgctgccaattggatgccctctgtctgtttcacgttgtttttaggttaactgtttcctgtcctgtgctcttgcagttggcatttcttaatgcaagtcatggactttacttgtgtctccataatatcttgtcctgtaggtgttagtccagtcactcaaaatattataaaatacagatcttttccttttctttttttttttttgagatggagttttgctcttgttgcccaggctggagtgcagtggtgcagtctcagctcactgcaacctccgcctcctgggttcaagcaattctcctgcctcagcctcccgagtatccaggattgcaggcgtgcaccaccacgcctggctaattttgtatttttagtagagacggggttccaccatgttggccaggatggtctccatctcctgacctagtgatccacccacctcggcctcccatagtgctgggattataggcatgagccaccacgcccggctggcaaaagactttttaaaaaaactttcacatattgaacacttactccatgacagatgctgtactatgcatatggtatctaacttcctccttacgctggcccagtggaaacaggtattaacgtcccattttacaaatgagaaaactggggaaaggaacaaagatgaatgtatcctgatttctgagggtcttttcggctgatgactgagcagggagatgttctacacacacagccatttaagccccacccagcagtcctaagggaagagttaggctcagcaccggatgaaaggcttgaaccacgggagcgagagcagaagaaaaactcactcctggttccttctccctagggtgacacctcatccaccttttgaagaaagtggggccaggcataggaatggaccaagaaaatgaaaaacagttaaagctggattttaaaaataaagcttattgagcatataatgctataaaatgtgcttgctcatgcagttgtcttggatgtaagaccctgatatttggatacagtggctttatcaggatgaaatattttttcttccttgacttccaccatgcccagttaattttttgtatttttagtagagacggggtttcaccgtgttagccaggatggtctccatctcctgacctcgtgagccgctggcctcggcctcccaaagtgctggaattacaggcgtgagccaccacgcccggccttgacttccttttttggttttgcgggagggaatggattgagtgaaggaggaaccccacacagtctactctatctacacagcatttatgaccgtgtgatatttttctttttctttttttttgcctatagtttcttgttggaaaaagacacgttttcttgttgactgttgctccccgacagaaatgtgagctccacgaaagaaaagtcctggcttttcctctctgtatacctgttacccagaacagtgcttggcacctgtgaagtgcttcagacatattcgatcaataattaaagaatgggtctatgtatggcacagacaacctagcgtttttaaaagatgatttaaaaacagtgtaaattctgagcaaggctcactctagatgtggaggtagtcacgtttaaattacaagaaaaaattgcagccaggcgtggtggctcacgcctgtaatcccaacactctgggaggccgaggcgggcggttcacttgtggtcaggagttcaagcccagcctgacactcctctaatcccaactactcaggaggctgaggcaggagaatcgcttgaacccgggagggggaggttgcagtgagccgagactgctccactgcactccagcctgggcaacagagcaagataccatctcaaaaaataaataaataaataaaaataaaataaaattttaaaaaaggataagaaatagaaaaagaaaaaattgctaatacccagtgccaagccagagctaccttttgataaaaaacaaatactgccctctgatggtagtagttttttaatttttaattttagcagcaataaacatcctcatttcctgaataccaaactatggctgcccacgatggcagagccagtgggagggacaagaagatgcacaatgtgctttgccatctgagtccaggataattctctcagctaccacccactacacacccacacactacacacccacacccacccactacacacccacacactacacaccccacccattacacacccacacccacacactacacacccacacctacacacccacacccacccactacacacccacacactacacacccacacctacatacccacacccacccactacacacccacacactacacaccccacacactacacacccacacccacccactacacacccacacacccacacccacccactacacacccacacacccacacccacccactacacacccacacacccacacccacccactacacacccacacactacacacccacccactacacacccacccactacacaccccacccactacacacccacacccacccactacacacctacccactacacacccacacctacacacccacccactacacaccccacacccactacacacccacacacctacacacccacccactacacaccccacacactacacaccccacacccactacacacccacacactacacacccacacccaacacccgtacacccacaccacaccccgcacacccacacactacacacccacacccaacacccatacacccacaccccacacacacccgcatgcccacactcacacacccacaccccacacacacacccacacacccacattcacacacccacacacccacacccgcacacctgcacaccgcacagccaaacactacacacccacacactacacaccctaaacatctacacacccacacacccaaacacacacaccacacacccacacacctgcacactcgcacactgcacacccacacacccagacaccccacacaccacatcccatacccacacaccacaccacacacccacacaccccacacccacacacccacacaccacacaccccacacaaccacacacaccacacacacacccacacacacccacacccacagaccctggacaccgccacccacacaccacatacccacacaccccacacacccacacacccacacacccacatgcacccacacaccccacacacccacacaccacacacaccccacacaccacacacccacacacaccacacgcacgcacccacacaccacacacccacacaccccatacacccacacaccccaaccttccaactacattactgcccctagccttttttttttttttttgatacggagtttcactctgttgcccaggctggactgcagtggcgcgatcttggctcactgcaacctccacctcccggattcaagcgattctccttcctcagcctcctgagtagctgggattacaggcgcccgccaccatgcccggctaattttgtatttttactagagacgggatttcaccatgttggtcaggctggtctcgaactcctgacctcagatgatccacccacctcagcctctcaaagtgctgggattacaggcatgagccaccaggcccagccctagcctctcttatatagaaattctagaaccccactgattaacttggcagtgctagggtgggcctgtccagacgcagtgtcaggaagatagtgacacagcttgcttgcttgcgccagctgggatccagaggcgggtaacccgtaacatggcaattgttctttattctgtctggcttctcaacttgacctcttcttttttttgcctccaacttgctgctctttcctgcttcctgttatcagctcctctcataggtagaaatgtggaaaatctaaaatatattagtccgatgcatcaaaagcataccctaaaagggaggccaggcgtggtggctcatgcctgtaatctcagcattttgggagaccaaggcaggtggattacttgagctcaggagtttgagaccagcctggccaacatggtgacaccccatctctactaaaaatacaaaaattagctgggcgtggtggtgggtgcctgtagccccagctactcgggaggctgaggcaagagaattgcttgaacctgggaggtggaagttgcagtgagctgagattgtgccactgcactccagcctgggcgacagagcaagactctgcctcaaaaaacgaaacaaaacaaaacgcaaaagcatccaagcatgccataaaaggctaatagatttttttaaatttgttatttatttatttttgagacaaggtcttgctcagtcgcccaggctggagtgcaatgactcaatctcagttccctgcagcctccacttcccaggctcaagcgatcctcccacctcagcctccctagtagctgagaccacaggtgcacaccatcatatccagctaatttttttgtatttttttcagagatgaggtctcactttttgcccacactggtcttgaactcctggactcacctgatcctcctgcctcagactcccaaagtgttgggactataggcatgagccactgcacctggccctaagtgttgggactacaggcatgagccactgcacctggccctaaaaagatgttaatctgtttatcatacaggctatcagtgccaaagtataattttcaaaattcaaaaaacataattctcatataaatagaaaatgaatccatgtttaagacttattaacccattggtgaagaagaccagtaagatgtaaagctagttcaaagaatgtttacaggcattcacaaagggatgttaaaataagactgttagtttagatataatagtggttaatggactggacgcagtggctcacaattgtaatcctttgggaggccaaggtgggtggatcgctttaggttaggagttcgagaccagcctggctaacatagtgaaaccccatctctactaaaaatacaaaaattatcagtcatggtggtgcacacttgtaatctcagctacttgggaggctgaggcgggaggatcacttgagtctgggaggtggaggctgcagtgagccagcatacggccactgcactgtattctgggcaatggagtgagtcgctgtctcaagggaaaaaaaaagcggttaatgtcctctagggaaatgaaaataaccttcacagttatattttttagtgtgcagaaatcttcaagttaatatgcagctgcaccatgtctaggctctaatcaaatagtaaatagcaaagtcaaacagttacattgttctagaaaattaacccttgtggaagcttttaaataatgccccagtatgacattgaaaagacatgtggccctgatttttgccttattgtaagttttgggtagttttggatagttaacacaagtttatgtattcttcaacgtcttaccttcttctattagtctttccctgttttggagtgtgttagtacttctcaaattaaacagtggatatgagaaacagaaaatgtaaatctctgaaaacttctgttgttactagttgacaattctaatttcagggtggggagaaaaaaggaaaagtgagggaagagatgaaaagttttgagttaggccaggcgcagtggctcatgcctgtaatcccagcactttgggaggccgagcagggcagacacgcggtcaagagatcaagaccatcctaggcaacatagtgaaaccccgtctttactaaaaaaaaatacaaaaattagctgggcatggtggtgcacgcctgtaatcccagctacttgggaggttgaagcacgagaatcgcttgaacctgggaggcggagcttgcagtgagccgagattgcgccactgcactccagcctggcgacagagcaagactccgtctcaaaggaaaaacaaaacaaaacaaaacaaaaagtctgggtgcagtggctcatgcctgtaatcccagcactttgggaggccgaagagggcggatcacctgaggtcaatagttcgaaaccagcctgaccaacatggagaaaccccatctctactaaaaatacaaaaaattagccgggcatggtggcacatgcctgtaatcccagctactcgggaggccgaggcaggagaattgcttgaaccctggaggcagaggttgcagtgagctgaggtcatgccattgcactctagcctgggcaacaagagtgaaactccgtctcaaaaaaaaaaaaattttgagttaaatgaattttgaggattatatataatgaggtttaatgtatccattctatttctattgttcattattagaaataacagatacctctaagtttcctgagggcagagaaggcctctggccaaaaatgtgaaaattatctagtatccagtatataatatcaggaaagagggagaatggaatcaagaaatatttaatagtagtgatgacagatgtcttggctgtggctaaaatttgcttctcagtagagaggcatatggcaatcttactggcccaactacacaaggctacagttaggccacggaggggagaagaaggcagccttaaaaggttcctggattaggcgtccacgtttaagttaggcccaaggaacattcattccatttgaagactgccctatctgtcttgagcatgtaccaccatttttttccttttggtggaccatgtgtatatacatatatgtgtgtgtggaaattttttttccatttttttacaaatggaaaatatatatatttttaaatctaaccttcctaatctttttaattttattttattttatttgagatggagtttcgctcttgttacccaggctggagtgcaatggcgcaatctcggctcactgcaacctccgcctcccaagttcaagtgagtctcctgcctcagcttcccgagtagctgggattacaggcacctgccaccacgcccagctaattttttgtatttttagtagagatggggtttctccatgttggtcaggctggtctcgaactcctgacttcaggtgatccccttgcctcggcctcccaaagtgccaggattacaggcgtgagccaccgcgcccagcctaaccttcctaatcttttatcacttctcttctctgtacttcttcttccctttttcctatctactataggaattagctactatatattatctactatatatatattatctactataattccatctttttacattttcttcttcaaattgttggtgcagttgccaataccatagtaagcattttgtacccacccaagtgactttaggatctggctgattttattctccattttgccactcatcaatgttcccaggatctttcaacatctgagctgttgctcctttagactcctcgatttcacaggactctgtaactttcttgatttcctgtacttccctctctatctgtcttggtttggaatgtgaagaggccggatctgattagcaccagggcttctaaacttctgagatctctttactcagcattccccttctatgacccaattgctttacctattttctcccaagcaaacctgccacaagttgctagaactgccctgtgcaacgagtcagcccctgtcattttacacgctgtctgctggctccacaggactctatccagccttagattccaagctccactgctttgcgctgcccttgccagcttcccggccttcctcagtccctgatgcctgctctgtccactgtatcagtctcttcccggaggtctcccggcctattcttgagagacagttggtccacattgtgtccagagatgggagaggctaatggaagaggcttattcccttgttaatggaattttttgctgcaagaaacagaaaaataccaatttaaattgttttttatctttattatctttatttatttatttatttggacagagtcttgctctgtctccaggctggactgcaatggtgcaatctgggctcactgcgacctctgcctcccaggttcaagcgattctcctgcctcagcctcctgagtagctgggactacaggcatgctccaccatgcccggccaatttttgtatttttagtagagatggggtttcaccatgttggccaagctgatctcgaactcttgacctcaggtgatccgcctgctttggcctcccacagtgctgagattacaggtgtgagccactgtgtccagcctaaattggtttttgaaatgtgaaatttggccgggtgcagtggctcatgcctataatcccagcgctttgggaggccaaggcgggcagatcacaaggtcaggagtctgagaccagcctggccaacatggtgaaatcccatctctactaaaaatacaaaaatttctgggcgtggtggcgggcgcctgtagtcccagctactcgggaggctgaggcaggagaatcgcttgaacccgggaggtggaggttgcagtgaaccgagatcgcaccactgcactccagcctgggagacagagcaagactctgtctcaatcaatcaatcaatcaatcaataaaatgggaaatttgttaattcatataacgaggtagggcagcctccatgtgcagcatatcagggttctgtatccttctttctgtgattctctttgttctgccctcattaatgatgactgtcatcctcaggctggcaacaaaacgaccacagtatttcccaatatcacattcagacacaaccacgtctagagaagcagagaggccttttcttttctcccacaaatatagaacacctttctacagttgatctcagccgaaaggcagagaagaaatctagaacatctttctcacaagtcctcatagatgctgctttcacatctcattggtcagaaacaggtaatgtgcccatctctaaacaaatcacagacaatggaatgggatcactggtatttctttattattcatttttaaattttattctttatttatttctttttcttttctttttttttttttgagagagagtttcactcttgttgcccaggctggaatgcaatggcacgatctcggctcactgcaacctctgccttccaggttcaaacgattctcctgtctcagcctcccaagtagctgggattacaggcatgtgccaccatgcctggctaattttgtatttttagtagagacggggtttctccatgttggtcaggctggtctcaaactcccaacctcaggtgatctgcccacctcagcctcccaaagtgctgggattataggcatgagccactgcacctggcctattctttatttcttttagagacagcgtcattctgtctctcacccagcctggagtgcagtggaataatcatagctcactgcggccttgaactcctggctcaagcaatcctcctgccccagcctcccaagtagttggaactacaggtgtgctaattttttaaaatttctgtagagatgggcagggagcactctcactatattgcccaggctggtcttgaactccaggcctcaagcaatcctctcacctcggcttctcaaagtgctgggattacaggcatgagcacaccgtgcccagagatttatttagatcagtcaggatttgcctccggatctgagacttgtgtgggaggcttatacttgaacaacaaaattggacttctgcaggcaataaagaaggagattaaggatgttgagtaggtaatcagcagtatctgctatagtgtgaaatggtggaccattgagaggaagactttataaacacttttcagcttgaaggtcgctaatttaaccattaacggtctcttcttgtaaatttgaccatgggaagttcttttgttagtttgtcggttgttttttcaggggagatggtgaggatgggggagattctttttaatttctaactcctggccgggtgcaatggctcacgcctggaatcccagcactttgggaggccgaggtgggcggatcacaaggtcaggagtttgagaccatcctgacgaacatgaaaccacgtctctactaaaaataaaaaattagctgggtgcggtggctcacgcctggaatcccagcactttgggaagccgaggcgggcgaatcacttgaggtcaggagttcaagaccagcctgaccaacatggtgaaaccacatctctactaaaaatacaaaaattagccaggcatggtggcgggtgcctgtaatcccagctactcgggaggctgaggcaggagaatcactgaacctgggaggtggaggttgcagtgagccaagatctcaccactgtactccagcctgggcgacaaagttagattccatctcaaaaaaaaaaaaaaaaaaaaaagtaactcctggattatccatttttgtttgacatccccagaatatactttctccatctatgttgaacatatccaaccttagccttgcatctgaaaaaaggtcctctgctcacctgctcttttcaccctaactactccctctctcctatgcttcttcccatctcgctctaatcccatggctctgcttgcgccatttaggggaacacagaaatcgttaacctcaacctgctgtcggcatcataaactgacctgaccataactacatcagtcttttgtcttgttcttccttctccttgaaagctgtctgtttccagacatcctgaggagtttccacagagtaaatactcaaaagtgtttactgaataaatgcatttattctgtcccttctccagcctttttcaacctccacctttgtgtgggcgcaaggaatttttacatgtatttttggtcccccttgctcagtcttcaaacaatggtctgcagacatttgttttctattttttaacagctttatcgagacataatttatatagctcagtatataccataacatttacctgtttttaagtgcacaaatcaattcagtgaatttatagaattgtgaaaacaagacacaatccagttttaaagtgtttgcatcaacctccaaaaaatcatctcccatccccagccccaggcagccataatcaattcccatccccagacccaggcagccataatcaattcccatcctcagccccaggcagccataatcaattcccatccccagccccaggcagccataatcaattcccatccccagccccaggcagccataatcaattcccatccgcagccccaggcagccataatcaattcccatccccagccccaggcagccataatcaattcccatccgcagccccaggcagccataatcaattcccatcccccgccccaggcagccataatcaattcccatccccagccccaggcagccataatcaattctcatccccagccccaggcagccataatcaattcccatccgcagccccaggcagccctcatctgctttctgtctctatagagctgctttaaaaaaaaatatttcatggccgggtgcagtggctcatgcccgtaatcccagcaccttgggaggccaaggcgggtggatcacctgaggtcaggagtttgagaccagcctggccaacatggcgaaacctcatctctactaaaaatacaaaaattagccaggcgtggtggcgggcgcctgcagtcccagctactggagaggctgaggcaggagaatcgcttgaatctgggaggcagaggttgcagtgagccaagatcacatcactacactccagcccgggcaacagagtgagtctccatctcaaaaaaaaaaaaaaaagaaaagaaaaatcttgtggggaatgcctttctacgtatgacaaaaggtgcagatgtgtagagaaaaatattcataaattttaccacattaaacaattctaccaggaaaaaatatcaaatttttttaaatgacaaggtggaaatatttgcaacttatttcatagactaaggactaatttccttgataaacaacttttataaatctgtaagaaaaagaccagcaacccaataaaaaaatgaacaaaggacttaagttatttcataaaaaatgggtcttggccgtgtgcggtggctcacgcctgtaatcctagcactttgggaggccgaggtgggcggatcatgaggtcaagaaatcaagaccatcctggccaacatggtgaagccctgtctctactaaaaatacaaaaattagcctggcatggtggtgcatgcctgtagtcccagctactcaggaggctgaggtgggagaattgcttgaacccaggagggctgcagtgagctgagaggttgcagtgaggttgcagtgagctgagatcgcaccactgcactctggcctggcgacagagcgagactcagtctaaaaaaaaaaaaaaaatggttcttaaatatatgatactcagaccccctcaaaataagagaaatgcaaatcaaaactataagataccatttttatattagaatattggcaaaactcaaaaagtttgataacattctccattgatgagtatatgggggaaatgggtactcaaatgtattgctgatagtttaagttggtacaaccttcgtggtaagtactacgcattggtaaaatgcactccaacctcatctcctaccatttcttctcttgcacaatttgtattagccacattggcctcctgctcctcctcaaacatgcaaggcacactccagccccagggctaatacacttacctttccccgctaatcctgaaatgcataccaatttttccttgcctccttcaggcctttgctcatcatgtgatctaaaacagtggctcccatcccctctatcattctccttttcatcccattttgagcacttaccatctgatgacactattctatgcatttatgtctctgctctccaactgtaaacccaggactttgctgtatatactgctgtaaccccaaactccagaacagtacaggcttagaatgtagtaagtgcttattaactacaaataatgaatgaatgaacgtctattggtgacaacttagtatctattaaaacttagaatgcacatacttagtaattcccctttaggcatttatctaatagatatccttgcatatgtgcaaaacagagaatgtacaaggttatttgttgtagcactgtttgtagtcatgaaaggagaaaacaacccaaggataaatttttttttttttttttgagacagagtttcactcttgttgcccaggctggagtgcaataatggcatgacctcggctcaccacaacctccacctcccgggttcaagcgattctcctgcctcagcctccggagtagctgggattacaggcatgcaccaccacacccggctaattttgtatttttagtagagacggggtttcttcatgttggtcaggctggtcttgaactcccaacctcacgtgatctgcccgcctcagcctctcaaagtgctgggattacaggcatgagccactgcgcccagcaacccaaggacaaattttaaaataagttacctatagccaggcacagtggctcacatctgtaatcctagcactttggtaggctgaggtgggtggatcacttgagcccaggagttccagacaagcctaggcaacatggtgaaaccctgtctctacaaaaaatacaaaaattagccaggtgtggtggtgggcacctgtactcacagctacttgggaggctgagaggggaggctcacttgagcccaggaggttgaggctttggtgagctgtgatcatgccactgcactccagcctgggtgacagagtgagaccctgtctcaaataaaaaataaactacctatatctatacaataaagaataaaggaatactatgtagatatggaaagatctctaattcagaaaattatttggctccctttggctactgtatgtatgagatctgactatttcaaaactctggtgatatcactacaagaatgagctcccttttaatgaagtgcttaatggtaaggagagtggaagtgaacaggtagaaacactgagtaattattttcagttttatttaataaacatcaatttccttgtagaaaacatagaatttctaccaactaaacaatattgtaataaggataaatgtatcaaatcacagataatgttgttaaacgaagatgctgtcttgcagatccattcatgaacaggcctaaactggcagtgcctattgttcatttattatgggtggatttcccattttacaaacaaaccttttatttatgggaagaggttcagcgtttcgcaatgtctttagtatgtatttcccgataccggaggggcagaattccccctctgtccatcaagtgacatctgcttgcagctgtagggaattttgcagggtactcttttccagagataaataatataaagatataacacataagaggtaattccctggtaaccatatatgtcccccaatcttgtcttgtcaaactataatttgcttatggttcctcaaaaaaaaaattgtttcttgtccctttactacttcccctctccttcttttcagttgctcttatcaggaatcctacacaagcatctacctaaacactactatttcaagggccaggccacctcctatctctttactaaaggacaaagtcttcccttactattctactctacagtaatatatgctctggccttctttagcctttatcatgcatttggcactaatgtttgtgttgcttaatactgctaattagcttttcacaggttttgacatcttccagtcagattgtaagcttttttttttttttttttttgagatggagttttgctcatcgcccaggctggagtacaatggcgcgatctcggctcactgcaacctcagcctcccaggttcaagcgaatctcctgcctcagcctcctgagtagccgggattacaggcacccgccaccacgcctggctaatttttgtatttttagtagaggcgaggtttcaccatgttggctaggctggtctcgaactcctgaccttaggtgatccacccgcctcagcctcccaaagtgctgggattacaggcgtgagccaccgcacccggcatgattgtaagctccttaaaggcagattcctttattctgtttttcccatactcctcatgcacctacatagtagatgctttaaatgtcctggttttgaaaagtaacatggtcaatcccctataacccaacatatttagtattctttacagcttcttccagaaccagtctggtaataaacatggatattctgctagcccaatgcatgttttgagtgtttggtatcagaactcatcagctgactctgtgtcccagccacaggactgcagttgatcgtcctgtggaaattcaacctcaatgtcataaacaaaatttggatcatccttcttcttctgatttttctcaaaaagttcatccatgatgctctttcttttggcaagctccttgtcatctagtttgttcaggtcttcctcaggatcaatggttgtttcccgttgaatttgttccattgtttctgccagactctgccccgacaagtaacctcgtaaaaaactgaatagcttctctagctgcctcagggatacttgttctaggtaactcttgtgtcgcggattattctttaattgttcagcagctctggtgcaatctgggagagagaagaaaactatataccacatacgtaccacgtacatcatatacgccataaactactgcaacagccaaaacagaacaaaaactctgaaccctgaaaatattatctccattatagtcaagtagctaaatggcttgattggaatgaattactttgtagaaccattcctttatattgagctttcagtgtggtgggagaaggacagatacagttttgacttctttaacttaaaaatcactttgtagagatattaaacactttcaactggagaatatgtctgagaagaaaagtgatattatagcttttagatagcagtagtggtattaataaaatattaagactacaaataaaaaacatttggaatgagagaagggaattaatattattgaataatgctatatcatttaacctaggcagcaatcccaaaaggattattaattatcagattggaaaaaaacactacaattcccttttatagattaggaaactgaagctcactgagagtaagtaattcatccagtgtcacacatccagtccctgacagagtcatgatgtgaacctgtatttagagaatatttaagacaggaggcaagataagacatgaggtacctgaaaactttgaaaagtttcgaactggcataatgcgctggcgaattttccccttgatttcactctcatagattaagataatagctggaggctgaaacctaatcccacatttcttggcagtgcacatcattcccatgtacatgtccgggtaagtcagaggaaatctgatgaatatgtgtaagttgcataatgacttcctgctaaagggaaaaaacaactaggtgttggataaatgtcattcattcccctcgcccctttgccccagaagatctggttctagtccggctctggccacacacgctcagcctgtgaaactcattttttttaaaattaaaatacggactgcttcatgaatttgtgtgtcatccttgcgcaggggccatgctgatcctctctgtatcattccaattgtggggtatgtgcgcgggaacgaccacaaagctcagttattttgagaactgccctgaaagttcagcttggccctgggttagtttcaacctgttggatccctaagatctggttttttcaaggatatagacttgttcatatgtgaatctggggatgcaatccagtttgaacctcttagtgtactgcactcttactgaagatcgaatatgaacccctaagtcagcccaatagctgacctatagggtctttactatttatcaattaagaaagggcatatcgagcatcctcggtatcaaggtactatgataaggtaagttttttaaccttaatcattttgtcctgagaggttcaccaatccagaactgtctcctttgtactttcccaattattttactagagttttttgtcattatttatttaatcatctatcttcccttctagtcaatatgctccatgagggtggggggcatattcattttccaccacaatatctcagcataatacctggaacgtagtgggcattccatacattgtttaatgctatgaattaacatgatggtccctgtacatttttgaaagcatttacagtctagaagcctgatcaaaaagcagacctgctgcagaatcagcttcttcatatacacgtcagtaacgtctgcagctacatcatatacatcacatatctcagcttcttcatatacaatagtcagtaatgtctgcagggcttttattttggcctgtgtgtctcactatatgataattttctagctacaagaaacagctatttgtagatgaatacttactattctctcttcctttccccaccctcagtgcccaaagaatacacttaaccctaagcactgcttttgatgtgactgtgacattcccagaaagatttgtaaatgtcaagaaacattgaggtaaagtggcatagggtgatgatatcttcgtgaactcagttctgctggagaatcactattaggaacatactttttattaaatacttagcagtgattatacacgtcattgtagaatactgggggcaaaggagaggggaaacctatagaaaataatcacccttgattgtgtccagtcttttttctaggcatatagtttatagtatgtttcatacataccttatcatacaagctatttcctgacgttcaaatttaacaacatatattattattttgtcatcaaatgttttactacaatgtaacattttatatgactgctaaatgttttattttatggatgtactataatcatattattcaccacttattgttgggcatgagaatttttactcttagaaaattaatcacatataagcccaggcacagtggctcaccccagccagcactttgggaggtcaaggtgggcagatcatttgaggtcaggagttcgagaccagcctggccaacatggtgaaaaccacgtctgtactaaaaatacaaaaattagctggacatagtggcaggtgcctgtaatcccagctactcgagaggccaaggcaggagaatcacttgaacctgggaggcggaggttgcagtgagctgagatggtaccactgcactccagcatgggtgacaagagcaagactccatctcaaaaagatggaggcaggtgtggtggctcaggcctgtaatcccaacactttgggaggccaaggagaggagataccttgaggccaggagtttgagaccagcctgggcaacacagcgagaccatgcatgtctctacaaaaaatttaaaaattggccaggcatggcagcatgcacctgtagtcccagccacaccaaaggccaaggtgggagaatcgcctgaacccaggagtttggggctgcagtgagttgagatggtgccactgcacaacagcctctccaaagcatgatacgcctattcttaaaaaaaaaaaaaaaaaaaaaaaaaactactttaaaaaattactgtgctctacctctaatctgatgcaatgagctcacaccatttctccttcttttccttctcttttcttgctttttttttttttttaacgaatactattcccaattcacctaactaaaatttgatgttagtaaactacaacctacggggcacatataaactccacacactgaagcaatggctgtactcgtcaaagatgtatgcagttggtactcaaataatgtagttttttttttactagactctttttaaaatttaactttaatttttgctaaagtaatgtttgtatttggaatataaaataattctatgaggcttataacaacaaactatcgtccttggccctactcctcttcatagggagccagactgaattttaaaaggcatatcttccaaaatttctctctccatttcttaagaaacatgcttatactaccattttcagtttttttttttcttttgaaacagagtctccctctgtcgcctaggctgcagtgcagtggcgtgatctcccctcgctgcaacctccgcctcctgggttcaagcgattctcgtgcctcagcctcccgagtagctggaattacaggtgcctaccaccatgcccagctaatctttgtattttcagtagagacggggtttcgccatcttggccaggctggtctcgaactcctgacctcaggtgattcgcccaaagtgctggggctataggcgtgagccacctgcccggctattttcagttttggatagtatgttttgacatacactctgtttcctctttgagacacccgctctagagccctctattccactccaagccgcctggatgctctcttggcctgcttacagattccactctgtttaggaagaaggacggcacgtttatccaattattcttcctggacacgaatactcctctccccagagatcagtaactgcccacaatcttgttaggaagccccacagcacctaagggtacgaatgtccccaaagagtagacgattctctccctactcacgtctccactagtgcaaggctggctttcttacccttagaggaatacagaaatgacatcgtctgcaggccaacgtctaaacaaccaggagtgggtttttccacccaaccgcagtgcacgcaaagcccctaagccgactgtgagaccgggcggagcctggcgctgcaggaagaggcgacagccacagccctactgacgagcccgaggggtgaactccccggcgggaggcccgaaccctcaaacaccgggaagcggaggtgggggccggctgggggaccggtccaccggctcccacctcggcgtacagggattccaggtcccggcgagcgctggcctagcggtttccacagcgacaggccgggcgcgcgtccccgcgcgtgcgcagctcctcgcccgcccccgggtgggcggagcaaggaacagctgggcggggacgaccgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggtaaggtttgatgggaggaaagcacaaaccctacaagtttctccatctgtaaaatgaggatgtttctgtcatccttggtatcatttagatccgtttagtatctgtcaatcagtgcagttctgcttgtgtgtttacatattgggttttcaagtttatctaaacaaaggattatgaggccaagaagattttttttttgagatggagtctcactctgttgccaggctggagtgcaatggcgcgatctcggctcactgcaacctccgcctttcccaagttcaagcaattcttctgcttcagcctcccaagtagctgggattattacaggtgcccgccaccatgcccagctaattttttgtatttttagtagagacggggtttcgccgtattggtcaagctggtcttgaactcctgacctcaggtggtccaccctcctcagcctcccaaagtgccaggattacaggtgtgaactaccatgctcggccagaagaatttttaaacagttggatttggtaatctgtagaggcttccaacgttagcattttataattgaaaaggggtcaaaattagcggggcgtgatggcgtgcccctgtagtcccagctactcagggggctaaggcaggagaatcgcttgaactagggaggcggaggttgcagtgagccgagatcgcgccattgcactccagcctgggtgacagagggagactctgtctcaaaaaaaaaaaaaaaaaggaaaaagaagtcaatttccagagccagttcaccactaccaaagtaatagttaagaggaaaaatgttgaaggtaaattcacattcaacaaattcgttttaaaaatggtacttttgcctttaaaatcatgacattctagtatttgctgtactatttgtaaattagcctttctccggtcccaatgatcaactgctgtctggtgtacataccagtagaatttaagcctgttcataatttttcttctaatttaatttatagttggatagcagtcctcacttcccaccctacccccattaaaattaaacaggatgaagaaagatctggatttgtgctgggcacagtggctcacacctgaaattctaacacattgggaggctgaggtggaaggattgcttgaggccaagagttcaagaccagcctggaaaacatagcaagaccctgtctctgcaaaaaaatttaaaagtagccaggtgtggtggcgtgggcctataatcctagctacttgggaggccgatgtgggaggattgcttgagctcagaagttcaaggctgcagtgagctgtgatcatgccactgcattccagcttgtgtgacagagtaaggccctgtctctttttttttttttttttttgagacggagtcttgctctcttgccaggctagtgcagtggcgcaatctcggcttattgcaaccttcacctcccaggttcaagcgattctcctgcctcagcctcccaagtagcgggaactacaggtgcacaccacgacgcccggctaattttttgtattttagtaaagacggggtttcaccatgttggccaggttggtcttaaactgttgaccttgtgatctgcctgcctccccctcccaaagtgctgggattacaggcatgagtcactgcacccaggctatttgttcttttttttaagaggcagagccttgctcggctgggcgctgtggcccatgcctgtaatcccagcattttggaaggccagggtgggcagatcaccaggtcaggagatcgagaccagcctggccaacgtggtgaaactccatctctactaaaaatacaagaattagccgggcgtagtggcgcgtgcctgtagtcccagctactctggaggctgaggcaggagaattgcttgaacctgggaggcagaggttgcagtgagccaagatcgtgcaactgcagtgcagcctggcaacagagtgagactccgtctcaaaaaataaataaataaataaataaaaataaaaaaagaacaaataaaaatctggattggtacaagatacatatggaatttggggatttgtttattcaggaaaagatcatatgcttctccaaagcaaatacaatttcttttttgagggctggagatttttcagtgaaatgtaactagacaaattctcgaagagctgtaacactaaaatttcattcaattttagtgttgaaagtggaagtatcttaggctttaaaaatcaggcaaacctttcttctaatcggtcacgtagttagttgtatgacccagggccatttactaatgctttagaagttcaagtttcctcctgcaaacaaatggcagtgattttgcttattttgctatagatcgtgaaagttaaaacacatatgaaagcaccaagtagaggatctagcatgttagatattatttaaccagttatttttttctattcttttttcattccttcaaatagtttcaccttcacatcatttttcttaatgcatcttttcagaaatacatctaatggattcagcaatattcaatgataataacaggattatgtaaataatatatagttttctgtatgtgtttggggtttgtttgtttgttttgagacaaggtctggctttgtcacccaggctggagtgcagtggtgcagtctctgctcactgcagcctccctctgcctcctggcctcaagccatgctcccacctcagcctcctaagtagctaatttttgtatttttcttaatggagatggagtcttgctatgttgtccaggcttgtgtgtgttttttaaatgttcttcccacagatttacagcttttgaaatgggacaaagttccatagcaaatgcctggcagagttgctggtcaatagtaactgaattttcagttttaagatgcttacattgagtaatagttttctttttttgtgtttagagacaaggtctctctctgtcacccaggcttgagtgcagtggtataatcatagctcactgaagcccccatcccctgggttcaagcaatcctcccacctcaagtgcgagctggcacacctggctcagagtaacagcttgagtgtctggaatctggatgaagtcagtatactgagatttgtgcttattctaagtttacagtggaacccgttgaacctttacgtgcctccagctttgctttttgttttttttttaaaccttccagcatctccacaaggcataaatgtaccattttcctggttttgtaggcatggatgttagaatatagaagttgccagtatgtatctatctgatacacagtttcagtgaacaaggattaaaatggagatttcctggctctttagccatcctgttcctttttggtatcttgggatcacctgaataaagtaatattaataaaaaacacttacatagaacacttaatatgtattcttactactgttctaagtgcttctacttacattaaattcttacgacagctagtagagagataaactatcttgcccaaagttaacacagctgttaagttacagactgggatttgaaatcaggcaatctaactccagagtcactgttcttaaccacagtgctatattggaagtagatttatatatatatttcaaattgcttaaattttaaaaggttttgtttttaggttggttagattttctaggcaagtaaagcctactaaaataactcttttataattatttaaatattattttattcagtgcttttgtttttaaaaaaaaatcgtttggttcttataggcataagggccatgtgttctgaaattattttgaggcaagaagttttgaaagatggtttccacaggtaagttgcctgttgatttctatttctattaaaataatgtgtcatataattgagagcaaaaaattgatggttgaaatttgtataaattgaaaaatcaggccagatgcggtggctctcatctgtaatcccaacactttgggaggccgaggcaggcggatcacaaggtcaggagtttgataccagcctggccaacatagtgaaacgctgtctctactaaaaatacaaaaattagttgggcatgatggtacacacacctatagtcccagctacttcagaggctgaggcaggagaatcacttgaacccgggaggtggagattgtggtgagccgagatcatgccactgcactccagcctgggcaacagagtgagactctgtctcaaaaaaagaaaaaagaaaaatcacttgcttcctcaaagttactcagtgatggcatatgtggttcacactttgaaataatgattaactgagtggagcaaagaagaaaacaagtatgtattgtttaccacgtacagttgtcccttggtatctgaggggattggttcctcctggacctcccctgaggacaccaaagtcctcagatgctcaagttccctatatcaaatggcatagtacttgtatagaacctacacacaccctctcatatacagaggttgttatatatatacaactagtgcctatatatacaatattccatttaatcttcacagtggcatgagatagatgattttttcttatttttcagatgagggaggtagagctcaaacaatttaaataatttggtagaaattagggtgatagagctctgactctagcttagtactattatacttcaaagccatctcaagtactatgatacactgctctaaatcactatgtcttactacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaaggtgattattttgaaatgattctcagatacttaatatgtaaattctgattcatttatttttttttaatttttttatgctgggcacggtggctcatgcctgtaatcccagcactttgggaggtcgaggaccccggatcacgaggtcacgagttcgagaccagcgtggcaaacacggtgaaaccccatctctactaaaaatacaaaacattagccaggcgtggtggtgggcgcctgtaatcccagctactcaggaagctgaggcagtagaatcgcttgaacccgggaggcagaggttgcagtgagccgagattatgccaccgcacttcagcctggcaacagagcgaggcaaaactccgtctgaagaaaaaaaaaagggggggaagggtatagttatttcaccatgaagtatatttgtgttaggttttttgtagatagctttttatgagttgaggacttaatcttaagtttctagtttcctgagagttttctttcatgattgggtgttaaattttgtcagataccttttcttcctctgttttgagaggatcatacaatttttatattttattctcttaatatgatgaagtacattgatgtttccagtagtgaacgtactccttggtcatgcgatattatcttcttgaaatatatctggatatgttttgctaataacttgcttagtatttttacttgtatgttcatgaaggctactggcccatgactctgttgtgatgccttattctggtttcactgtctgggtattcttggccttataaaatagtttgggaaacattttcttctctagtttctgcttgtgtagcattggtattatttattcctttaatgtttaatagaatttaacaatgaagctctgtttttgtgtgtgtgtgctacatttaggattgttcttgatgctcttgataatttcttgatgaattggatgaattgacccttttatctttgtgtaatgtctttctttatgactgacaatattccttgtcccgaagtcaccttattctaatattaatatagccatcccatatttattattaatatttgcatatcttttttatccttttacttttatcgtctttatcttcagtgtgtttcctgtagatagcatatagttcagggtggccaatttttttctttccaaatcccaagaccttgtgaaaggagttgctgttttatccatctgtcagtctctgcattctaattggagtgattagaccgtttatttttaatgtaaatattaatatggttggtctggtttaaatctgtctagctacttttttatctatttgtttttctctttgttgcatctagtcttctccttcttttcttgccttattttgggtaaattgagtatttattttttatttttttattattatactttaagttctagggtacatgtgcacaatgtgcaggtttgttacatatgtatatgtgtgccatgttggtgtgctgcacccattaactcgtcatttagcattaggttaaattgagtacttattaagcattctattttatctcaatttttggatgattagctatacctctctgtttttaatttgttgctttagggtttacaacctgcaatcgttacctatcacagtctaccttcaaataattttattccatgtcacagatactgttttatcaggatagcttcatctccttctcttttctatgctgttgttatcacatattttactttattttttacttgtgttatgaaccccacaatatattgttactggtttttctttaagcagtcacttttcacattatttattttaattgtgataaaatacccataacataaaatttacaattttaacttttttttttttggtatggggtctcgctctgttgccaggctggagtgcatggcgcgatctcggcgcactgcaacttccgattccctggttcaagtgattcttctgcctcagcctcccgattacaggcgcctgccaccacacccagctaattttcgtattttcagtagagatgggatttcaccatgttggccaggctagtttccatctcctgacctcgtgatccgcctgcttcggcctcccgaagtgtggggattacaggcgtgagccaccgcgcccggcctaattttaacgatttgtaagtgtgcaattcagtggcatcaagtacattcacgttattgtgctaccatcaccaccatccatttatggaactcttcgttttgtacaactgaaactccttgcctattgagcaataactactcattcctcctcctcccagctcctggcaaccagcatgcttgtctctgtgaatttgactcctctgggtacctcatataagtggaatcatataatgtttgtgaagcttatttcacatagcatgatgttctcacagttccttcatgttttagggtatgtgagaatttcccttctttttaaagctgagtaatattccattgtatgtttgtaccacattttgcttatttgttcattgttgatgggcactttggttgctcctgccttttggctgttgcaaataatgccgttgtgaacaggatttacggttgtctcttaaatgcctgcttcatattcccagaagtggaattgctggatcatgtgataattctattgtaattttttgagaaattgtcatagagttttctgtagtggccacatcattttacattcccaccagtgatgctcaagggctccaatttgtctagcaatcatatttgaaagcaattaaaacatgagaaagaagtcttttatattcccccacatacttatcatttctgatctcttctttcttatagatttatgtttctatctagtatcatttactttctgtcatttcttgcagtgacaaattctcttagtttgtgtttgtctgaatctttattttgcctttatttttgaaggattttcctcctggatataaaattctagatcgacagcctcttttcttttagtaatttaaataagttgctccattatcttctagcttattcttatctttgttaatctctccatcattattgatagcttttaagattgttttccattgactggataataatgtgccttgatgtgattttctttgtatttatcctgcttagggttggttggcttcttggatttgtagacttataattttatgaaattcagaaagtgttcagccattatatcttcattttttttctgttacattctcttctcttttttaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctgggtaagtttttatttcggaaattatattcttcatctcttaaagttgcatttagttttttaaaaaatatcttctctctctctctcttttttttttcttgagacagggtcttgtctctgtcctccaagctggaatataatggcgctatcagagctcactgcagcctcgacctcctgggctcaaaagattctcctaccacaccctcccttgtagttgggactataggcacacatcaccatgtctggctaatttttttatttttttagagacaggggtctctccatattgcttaggctggtctcaaactcctggcttcaaatgatcctcctgcatcatttgaatcccagcctcccaatgtgctgggattacaggcatgagccaccatccccggcctattttttcttttttctttttttttagatggggatttgctctgtcacccaggctggagtacaggggcatgatcttggttcattgcaccctccacctcccaggctcaaaagattctcctgcctcagcctcctgagtagctagaccacaggcatgtgccaccatgcccggctaaattttgtatttttggtagagactaggtctcactgtgttacccaggctggtctcgaattcctgagctcaggcagtccacctgcctcagccttccaaagtgctaggattataggcatgaggcaccatgcctgccctctggcctgtttttttctgtgtaaatatccagttgtttcagtgccatttgttgaaaagactatcctttccccattaaattacgttggtacctttattgaaaattgtgtgaatgttattggattccattccttttcattgatctttgtctatttttacaataatgctatagtggcttatgacatgaattatgaaagatctaatggatgattctgacatgttataaatatttcatttgaccttataatctacttttggaaaatgaattttgaaatacagtgttttcactaataggaatacagtgttatgttatctcatttaacagttgaatgaagagatttactttcaatgtacttgtcttacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggtacagttattaggggattttttgggagagaaattaatttaggggtgctgtagtttggattaaggaaaaatagtaggttttcttttcattttgttaaagtgtataaagtgacatttttagagatagactgggcatagtctttgacaagtgagtgactcttgtcaggaataagccaactaaactgagctagttaaatgctttttaaggtggttcatagttcagtgactaagaaaattatctgggtgtatgtgtatgtcttgagaaaattaatgattaataaatagtgcctcaacagtaactttgttaatgagaatgacatataccccaacatctgggtaagtttgatatgtgaggagaagaaactaatatttaatagatgtctatatgccagatatcttcattttcttttaaaaagaaagatcgtgtcctgcaccctttacataaattaatctttataacaaccctggaggtggaatctccattttatatatagggaaactgagggctgggtgcagcgtcttacgcttgtaatcccagcactttgggaggccaaggcaggcagattgcctgagcttgggaattcgaaaccagcctgggcaacatggcgaaaccctgtttctacaaaaatacaaaaattagccaggtgtggtggtgggcgcctgtaatcccagctacttgggaggctgaggccggagaatcacttgaacctgggaggcggaggttgcagtgagccgagatcgcatcattgcactccagcctgggtgacagaatgagactttgtctcaaagaaaaaagaaactgaggcgcaaagaggccaagtaacttatccaaaatcacatagataattggaagagccaaaaaatggatccaagattgtctagttgtaatgttgttgcccttgttggacctgaatcttaccccgtagttagaaaagtttccccaactttggtaagaattccctgggggcacttttgtacagagtattgccttccagggaaatcctgattcagtaggcctagattgggccccaaaatctggtttgaagaacccagatgatttctttttttttttttttttaattattgtgggtacgcagtaggtatatgtaacctaggtgatttctgttaagaaattttgggagacactgtcttagttgataagattataatctacttacgaatttttaaaactgtaaaatagatgcatctatagttattcatgatggcagtttatttctaatcgtggtttaggccagtttctttatccatttattttattttaattgtttttgaataagtaattacattctcatgggttcattgagtagatataaaaaggtatgcaatgataacattctgcctgtgtcaaccactaatcagcaagtgtgttctcagttttttgtgtatgtatgacagtttacatacacatacaattatggaaggacctcatttttttttaatttaatgtttttttttttttttttgagacagagtctctgttgcctaggctggagtgcggtggcacaatcttggctcactgaaacctctgcctcccaggttcaagttctcctgcctcagcctcccgagtagctaggattacaggtgcatgccaccatgcctggctaatttttgtatttttagtagaggtggggtttcacaatgttggcctggctgatctcgaactcctgacctcaggttatctgcccaccttggcctcccaaagtgctgggattacaggcatgagccaccggccagaaggatctcatttcttttcttcaatgaattatgaattctaaatgaggctattcaaatttaaaataatagatttcaaatttcaacacagtttttggcttgtaaggatatgggttggaatcatatttaaatctacttaataaaatcacttaccgtgttctaagaaaatcaaagttttttggatgggggttacccaaaaattcatatctttggatggggatgagatttggatgtttgaaggttgactgttagaagaaaagggtacaggtagagagtgccattatagattgattaacaagtttatcttgatcttgattttctgctttctaatcttctaatccataattataagccttgtaagtgtatttacttctttattttggaaacttctagaaaaatagatgttacatttgtgacgtttaaatatatggaatttgatgcctgacatattccttctgcctagttgagattatggcccaattcctcgtacagagaaactttgttatgctaagtgttattatataataagtgtaactgggtagaaggaatttatatgtagggactgattgatgcttgtatacctggattaatgtcttgactctgctccaggaaataaaatttttggctgcaacaaatggaactgtgggcccagattaaatgagtggtgtgccagcaaaatgctttgtaaggagtttgtgatggtttgtgaataatttgaaaataaatgcaagccttaagtaggttcaccaaggataaggcagatcaaataaacctcatttcacttttttaggtagggttattaaacatattttttcatcagaagtctcttagattctttgaaagcagtataatattagattgaaacgtataaaattgctgttttgtgggtcaaaatggaaacagtttttgaaaccataagttttactcaaagtatgtagtattaaggcttctgcttctggtcaagtggagaacaggtaacaaatttagtctcttacttgaaacaagcaagaaatagacaaaatatatgaaataatgaaaaaagtcattgaatatcaggcaatgaagggcagagatatccgagagaagggaagtaagtaaggtgagccctactgtcatccagcttatttccttgagaatattttcaggcttaatgcagggaggagaaactcaagcagagcctagtggactttttgagttgaggagataaagttgagatgctgggcaggccaaggtaactagaattcacgggacagtgtaccagaggggagagaacgtcatagaggcagaactgcagaaataacagaaggttcctttcaagtatgtagctgagtatttatcagtgtgtatatgttaggaaactacctgatgccagggaaagagccatctgacaaaatgagcggtaacagtgtctggtactcacacagggacaggagtagtacctcgtcccagcaaccagactgagaaaagccttataatttcttgaacaatggaaaaacagagaacttttactcagtagcagggaatacttagccacaaactgaacattgctttagtcctgcataacaaatcttaaaaacaaaaccttaaaaaaatatcaaactttttctaagtaacttatctgcatcccaaacaaagctcaagaatatgtatagggatatagacatatccagcaagatcaaattagcaatttcttgactgtaataataaattagcagctaggcaaggatggggggaaaaatgacctataatgaggaggtgaatcaatcagttaaaaccaatccagaattgacccagatgttagaattaacatcatctctactaaaaatacaaaaaattagccaggcatggtggcgtgtgtctatagtctcagctacttgggaggctgaggtggaaggattgcttgagcctagatggttgagacttcagtgagccatgatcatgccactgcactccagccagggtgacagagtgagaccttgtcttaaaaagagaaaataagaggctaggtaaaaaaaagaataggcagctcatgcctattatcccagctctttgggaggatgaggcaggagaatcacttgagcccaggagtttgaggctgcagtgcaccctgattgtgccactgcactccagcctgggtgacagagtgagagtccgtctcaaaaaataaaatagtagtacatataaagcatagtgagataaggctgccaaaaaactaatgcaagttttgcctaaagaaggtaatattgctcctgtactctatgagtacttcaaatgcagctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttataggttagtacatacagtttctactcatgaaaaagaaataaccttataacagtagatagatcgagatgacttatagtaatgagcttccttccagtcactgaaggtattcaagcagtggcggtatacctgaaaaatacctttgttgggacagtggtttaattttattacttccaaagtccctcatgactcatgagatgatataattccttgacttttgccaatgagttctgttcctgctgtgactaactgaaaaggaacaacatgtaaagaaaacatagcacttggtgtcactgtcagaggaaagttaggatgcttgatgtgatgggaaggagttaatgcataccagggttttgcatggacaatctaaagagaagttgtgcgtgtgtgtacatccatacatatacacataggtcgcgtatataatgcctgtgtgtgtatgtggatatatgtgagtgtgtgtacataaatatgtatgtatatgtggatatatgtgtaataaataaatatacatgttataacttaggtctaatttctgccacatgtacattttcacttttggtgtagaatactatacttttctataaaatagtttttaccatattattttaagcaatcatttactattttttccattaactgtttataccgtctctagaaagagtgctgacctttgctttgacttcctgaccgcagtgctcttactcactgccatctcacttgcttctctgaagaacaggaaattgtcagaatgataccaatcattttaactcaatacaggtttaaccttttgtcacagtttgtgtacttattgaataatgctatattcacaaaatttctctgtcttaggtacctattttgtcacctaagcaaagactaataagaaaatattacaggaataatttttattatggggaaatttggtaccctagaatataatttccccagtttttttttagtaagcagacttttattaagcataaattggtcttgtgtttttctccttaaaattgaggatggaaggggaatggaaattgcttataaaaggggcaaatttgacactgctgtgtatctgtatatagtcttctggttttaactttttaaaaatcttcctcattcatttcttcttgattaatatttattttctttttgaacaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatgcatctgccatccctgtccttgactgcgctgccccaactgtcatctccttccctctaagacgaacccaccatcctgactgttaaatacttccttatgtttctttatatgtttatcatccagatgggcattccaagacactataccaagactaaggtcttgtccatttataaaaatctattatttccattaagtctcttaatgtacaggtttctctctatccctttcctttcttcaacactgatctgttgaaagaacctgggccatttgacctgtagttggtcatagctggggttttgctaattggactcatgttcctcatacttctttatttactggaaattggcagctggctccagaagaatgatcagattccggtttgattcctttgacaaaactataggtcagtgctgtgttctcttctcagtagccatttaatattagtaggcatgtactatgtgtttctttttgcagccattggtccacattacccctctgttgctttttgtttcttgttatcagtattgcaggactctggcttttgatgttttgtttctacttgcatgtattttgatgtttgggaagatattttatcacctagttttgttgcagattttgtctgtgagtttttaattttgctgcataattgtcgtttctgtttttatgtgggaatgggtaaactgaaaaatcagcttttgctgccgggcgaggtggctcacgcctgtaaccccagcactttgggaggccgaggcgggtggatcatgagttcaggagttcgagaccagcctgaccaacatggtgaaaccccgtctctactaaaaatacaaaaaattagctgggagaggtggcgggcgtctgtaatcccagctacttgggaggcggaggcaggagaatcatttgaacccaggaggcggaggttgcagtgagccaagattacaccactgcactctagcctgggtgacagagcgagactgcgtctcaaaaaaaaaataaaataaaaaaaataaaaagcttttgcagtttgcagtcttctcaagatgttttctttctttctttcttattttttttttttgaggcggagtctcgctctgttgcccaggctggagtgcagtggcgcaatctcggcttaccgcaatctccgcctctcctgcctcagcctcctgagtagctgggactacaggctgcgccaccatgcctggctaatttttgtatttttagtagagacggagtttcactatgttggccagactagtctcgaactcctgacctcgtgatccacccgcctcggcctcccaaagtgctgggattacaggcgtgagccacagcacctggccaagacattttctttagtttacgaagcccctttcagtttttggttctttgtgtcttcaaatttgggttgatttagaatgtttataaaagttagtagcactggggccaggtgcagtgtatcacacctgtaatcccagcactttgggaggccgaggcaggcggatcagttgaggtcaggagttcgaaaccagcctagacaacatggtgaaaccctgtctctactaaaaatataaaaattagccaggtgtggtggtatgcacctgcaatcccagctacttgggaggctgaggcacgggaatcacttgaacctgggaggcggaggtttcagtgagctgagatcgcgccactgcagtccagcctgggagacagagcaagactgtctcaaaaaaaaaaaaaaaagttagtagcactgttactaaaaaccgacagatgggaagtttttaatactacatttgttaccgtcatacctttcatgacgagaaaattaaaaatgttcaattatattacctttgttcatccaaccttgttttctgtttctattaaaggtacctcttagcataaataaagtttgaaaaagttcctctcctgagagaactggattctgatattctgtctttttatctgaatgctcttttatgggtgtgtttcatatggaaatttatcgagttttgcacttacgatatgttcacttttctgagtgatgcttcaaaaataagtttacattaaatttttaagagcagccccaaatttgagtacaatgagattcattaagaagtcatgtttggccaggcgtagtggctcacgcctgtaatcccaacactttgggaaactgaggtgggtggatcacgaggtcaggagttcaagaccatcctggccaagatggtgaaacccgatctctactaaaaatacaaaaattagctgggtgcaatggcaggcacctgtaatcccagctactctggaggctgaggcaggagaatcgcttgaacccaggaggtggaggttgcagtgagccgagattgcaccacagcactccagcctgggtgacagagtgagactctgtctcaaaaaaaaaaaaaaaaaaaaaaaagaagtcatgttcaacttttgcaatacttttgtgattttctaatttcttaggcattcacataaaaaaggatgctaaaataacagaatgtgatagatgggtccagatcatatacataatgtattaaaatgtttgacaacttctgtctattgaggtttaatacaagcctagctttcagtccaaatacaggttttctgacatcattttctaccacttttctcagagttcccgattttgaaatgctgggctcactcagaagtggcagccccttgtgctttggagaatgaggatatctgccaatggaacaagatgaagtataaatcagtaagctaatgttttatgttgttttttagatcatgtgcctcatttaaagctctttctgtaatgttcctgccacatttaagagattagcatttttttttttttttaggcggagtctcgctctgtcacccaggctggagtgcagtggcacaatctcggctcactgcagcctccgcctaccaggttcaagtgattctcctgcctcagcctcccaagtagctgggattctaggtgcccgccaccacacccagctaatttttgtagttttggtagaggcagggtttcaccctgttggccaggctggtctcaaactcctgactttaggtgatccgcctatcttggcctcccagagtgctgggattacaggcatgagccaccgtgcccagctgggattagcattttctaatatagaaagctgttttttcttacagcaaagggttactacaaagcactgctgttttttgttggggaactttcattgaacatacagttgggaagatggatgactctgcaatcttatgcagtgtagagttgtttttgagtaggttgccattgccatatggtacctgaaaatttttctcaaactctaaaatacatctggagacctgcatttgattgattatgtcaatgaagagtatgcttagtgtttatgatttattgatttagcaaattagtgtgtattgctacaagataagtagtgacccttttaaaacattttgaattcagttgtccttatttatttatttatttattttgagacagagtctcgctctgttgcccaggctggagtgcagtggtgcaatcttggctcactgcaacctccgcctccctgttcaatcagttctcctgtctcagcctcccgagtagctgggactataggcgcctgccaccatgcccggctaatttttgtatttttagtagagacggggtttcaccttgttggtcaggctggtctcaaactcctgacttcaggtgatccacccccgtcagcctcccaaagtgctgggattacaggcgtgagccaccacacctgacttcagttgcctttaaaattctgtaacttgccataagaggtcataataatttaacactttaaatatagcttttaactatatgtatatattatttatatatatatatatatatatatatatatatatatatatattttattttattttatttttttttttattttatttttttttttgagacggagtctcgctctgttgcccaggctggagtgcagtggcacgatctcggctcaccacaacctccgcctcccgggttcaagtcattctcctgcctcagcctcctgagtagctgggactataggcacgtgccaccatgcctggataatttttgtatttttagtagagacagggtttcactgtgttggccaggctggtctcaaactcctgacctcatgatccgcctgcctcagcctcccaaagtgctgggattacaggcatgagccactgcacccggccaactttatatatatttcatcttcatatataccagaaaaataggtggccattactaaggtggtattccatcccaaggattgttgaagatgtcatttttttgaatgacggttttcagatagcactttgttgcagattgggttggttacttgtattttttggggtgtgaaatcataattcaggtatttacaaaaagaaaaagtattcccaagttacgtacattttaatgttttttaaaacttatttttaaagtataaactttcccagtgtttttcattgaactttatcttcaaaaccaaatagaaaatagaaactgagttgaatgtaggagcttttccattgctagtcatagtaaaggccacatccagctgtacaatatgggaataacaaggctttaaaagctatctggggagagaaaggcaaatgggaatgaaagaataatttagttttttgttgttttaatgtttttcctctaagtcttcaatttagagagaattctgtattctaatttgaaacatggtaagaggaagtaaatgtttatattgattacagaggtgacactgggatatagcttttcttaaaataatatactttatgtaaaaagcagaaaaatcagaactaatgagatttaacaaattattgtgggaattgagtctgattctgtaacattaaatgaaatgttagattcaaaagtcattcaaaccaataatattacatgtagtgtagcactggctgaaatatatttaaaagaaaaaggaaataaaaatatccaattaaaaatcaaagaaatagtggtctcaccttatgacatttattttattttactatttttatttatttatttatttatttgagacagagtcttcctctgtctcccaggctggagtacagtggcacgatctcagctcactgcaaacctccgcctcccgggttcaagtgattgttctgtcttagcctccctagtagctgggactacaggcacctgccaccacacctggctaatttttgtatttttagtagagatggtttagtagagatgttggccaggctggttttgaactcctgacctcaagcgatctgcccgccttggcctcccgaagtgctgggattacaggcatgagctaccacaccgggcccatgacatgcattttcaatgtctaacttctctctctctctccataggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcacaaaaaaaaaaaaaaaagggaaagaaaaagaaagaaatataccttttaaggagttcctttagtgtgtctctgttggtagcttgtttatgtttgatgatatatttatttcatcctcactcatctgatggataatttaggtagttgtacacttttttttttttttttttttttgagacagagtcttgctctgtcgtccaggctggagtgcagtggtgtgatccctgctcactgcaacctctgcttcctgggttcaagtgattctcctgcctcagcctaccaagtagctgggactacaggcgcacaccaccacaccctgctattttttatatttttagcagagacagggttttgccgttgttggccaggctggtcttgaactcctgatctcaggtgatctgcccacctcagcctcctaaagtgctgggattacaggtgtgagccactgtgcccagccggtagctgtacacttctaagcttggttattttctcttggtactttgaaaatataccattattgactggcacccgttttgctgttgtgaaatctgctatgaatgtaatagttgtttgtacagaatgtcttttctctctggttgctttatctctggtattctgcggtttcattttcatgtgtttgaaatttctttacttatcctgcttggtattcagtttgcttcctgaatctgaagattcctgtctttaatcaattctggaaatttttcagccattatctcatcattatctgcctctcttggtttttctcttttctctcctggaattctcattaggagtatggtagagaccttaacaatctatccccatgtctcttaagcttgctttcatttttcctgtctctaggctgttctcagtaatttcttttggtctgtcttccagtttactaattttctcttcaattgtgtgtaatctgctatttaaccaaacattggctttggtttcagttattctttgtttctagaaattctacttaattcttttgttgttgttgtttttgttttgagacggagttttgctcttgttgcccaggctggagtgcaatggcatgttcttggcttactgcaacctccacctcccaggttcaagtgattctcctgcctcagcctcctgagtaggtgggactacaggtgcccaccaccacgcctggctaatttttgcatttttagtagagactggggtttcaccatgttggccaggctggtctcgaactcctgacctcgggtgatctgcccacctcggcctcccaaactgctgggattacaggtgtgagccaccgcgcctggcctacttatttcattttcaaagctgtttggtcgttaaaaaaaaaaagcatcttgtttcttgctcgtgttttctagctcctgtcttactttctttaatcatttaaataggcgtactgtatattctgtagccatcaattccagcagctaaagtctgtgtgggtttcattatgttctttgtagtttctattgactcactcatcgctgcttatttcctcaggtgtattgtatttcgggtgctcatgtttggcttcggaaatcctgtttatctgtgaaatcctttgagaccgaggttgagggtacacctgtgcagtcaggatttgtatttgtttcttccaggccccccagaactccagcctgggaccactttcttgacaaatttgaactttaaaaccttagtgagggaaaattctaaagggttattaattctaaagggaaaattttcttctgccctgcaagcccactgcaggccaaagtaaacaaatgtcctgtgtgtctccctgggctagcatagggttttttttccccccagtctgttcttggagggtatagcgccttgaatttccagtcctatgcaggatcacagtcctgacttcttgtataggcccaagtccttgtctttagtttcctgtgcacctattaaaactctagagatttctgagataagtaggtgccctcaacacaaccatggcttcactgccctgcttaccactctggtgtcctgccccttcttcaggttgagtgtgaaatttggaagactgtcagaaacattctattttcattcttgcaagttatgcctttgaaaggatgtcttatttatccagtgtttctgtgtgtttaataatcagagcatttttcaggttatctcttactgtgccatgttgctccttgattcctttctctcctgtacccactgcatcaattgagttttttgctctacattgatagagaagcacaattcctctttctttccactgccttcctactttatttcccttctattcttgcatctctatactccattatccacattgcagtctagtgatcttaaagtgtaagccaggtaacatcgctttcctgcttaaaaaagccttttaatggttttttgtaatatagactttttaccatggcattcaggatctttcatgacctgaatcttgtctgctgtagtgttttcttaatagtaccgccttcttgttctaggccccagctacacaggccttcttaactgaccgtagcaagcccttttctttcttctcctgcctgtattgcttttctctgggtgcttcttattgctgtctctttctgttcttgccttaagtgtcacctccttaacgaggccttctccgaccaccctatccaaagtaacctcgccaagttttttcttataccaggtgtgactactttaattactgcgtcctcatataagctccacaaaggcttggtgaatcgtgttcacccttgcatttcttttgtgttttttgttttgtttttgaggcatgacgactctgtcacgctgaagtgcagtggcccgatcttggctcactgcagcctcctcctcctgggttcaagcgattctcctgccttagtctcccgagtagctgggactacagatgcgtgccaccatgcccagctaatttttgtatttttagtagaaacggggtttcatcgtgttggccaggctggtctcgaactcccgacctcaggtgatccgcctgcctcagcctcccaaagtgctgggattacaggcgtgagccaccgcacctgaaccacccttgtatttctgatgcttaacagtgtctagtccatatcagacactcaaatatttgtagaataagtgaaacattgatgaactcctccgtggataaaatagggaagtcttaatttgcaaggaggtgatacttaatttagcagcaaaattttagttaagaatttgtaagcaaaaaagcaaaatggataacggatgaattcccagaaacaaatgtcgcggagcagatgtgtataacagcaatcgtctgtcagcgtcttccgtcggcagagacctgcttggagacaatgctgaattaaatgagggactggctgctcctctcaatacaaagactacccaaggaataaaagcaacgtctatcaccgaactactactcccagcggcccccgcgcgggcctgcccatgggaggtggcgctcgtctccgccccggggagctccggcttcggggcgggaggggttctgggttctggccccgccccgccccgctccccgccgtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggtaagtgcacacaggccggccggcgcgggacgcaggccgggtctcttcctcctccttccttctccgtggcctggcgggcgggagcggcccgggacggccgacctgccccgcgcggggccggggagccgccacctgcgtgctgggagccgcagctcctggggcggtggctcattgtctgctccccagggccgttttcttcgctggctttagccagaaatgggaagctcgctgggctgcggaggtctgactcttcctggacccagccctgctctgaacctcgcggcaccacggtctctgccgactctcggtcttccctcccctcgcgtttcaccctcttcctttgctccgttttcttaatgctggaccagactctccggttttgttccttgatttttcctctcactgattctcagcccctgcttgctcgctctctgttcacccgtttcactgctcaggaatattgtcgcgagtagcttgactgttttctcagctccagcctgtaacctcttttccacattccacattggtaaaaacgtagagcgtcccgggcgcttgagggccaccgcttacgaactgatctttcggagcttctcctcgctcctgtttgagcttcagcctaggggtgaaatttgcttctttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttagggccttggtttatggtttactctcattcagagagagatactattctggactccgtgctatttaatactaaccttgcaaacccaaattcaaaattaagtttatagttcgagtatacaggcgatagggctctctgatctttatgatagacaggttcccaagtagatgcggttaacaattaatatttcttttttttttttttttttgagacggagtttcagttgcccaggctggagtgcaatggtgcgatcaccgcaacctccgcctcctgggttcaagcgattctcctgtctcagcctgctgagtagctgggattacaggcacgcgccaccacgcgcggctaattttgtatttttagtagagatggggtttcaccgtgttggttaggctggtctcgaactcccgacctcaggtcatctgcccgcctcagcctcccaaaatgctgggataggcgtgagccacggcacaccaccaacagtttctatttcaattatactttttaagagagactagaacttgttcaggtagctaaagataaactttcaattatacttttctaatatttaagaacttcaagtagccaaggataaaatgagtaggaattgttagattcttccttttatccatcaaaatcgattattattataataatatttgagtatatttcttttggctttctgacttttacacttttggttaaaatttgaaactgggtcttcttcgccgggcgcggtggctcacgcctgtaatcccagcactttgggaggccgaggcgggcggatcacgaggtcaggagatcaagaccatcctggctaacacagtgaaaccccgtctctactaaaaatacaacaaaaaattagccgggcttggtggcaggcgcctgtagtcccagctactcgggaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagctgagattgcgccactgcacttcagcctgggtgacagagtgagactccgtctcaaaaacaaacaaacaaacaaacaaaaaactgccttctaaaagaacgaagtttctgagaccgtaactaaaaataaaaattacttttggatgaataaaatgtaatttttcaggagaaaaaatatgtaatagtttcaccactgaaataaaacatagggtttttgaacacaaatttctcagatttaaaaatatgcatatttcctgtataaaagttgaaaagtgggcagtggctggtggtgcctgtagtcctagctacttgggaggctgaggatcctttgagtccaggaatttgaggtcagccaggacaatacagggggaccccatctcttaaatcagacaaaaataaaagtagaaaaaaatattaaataagaaatttggaaagtggtaaaaacttttaagacaaaattaccttagtctcagctggcagaaccattgtaacaaactggaacagtggttttgttccttattttaaatttaaattctaaaagcagtacatatttattataaaaggttcaaacaagtcaattaaatatttaaagagtgaaaattctttgggagactgaggcaggaggatcacctgagctcaagagttggaggtatagtgagctatgattgcaccattgcattccagcctgggtgacagagcaagaccctgtcttataaaattcttaaaaagtgaaaattactttctctttttagtcccattccttagaagtacctacccgctgttaatagttttacttactgagttagaaataagtagtaccttttgtgtgtcggatactttttatgttgattttaaaataaaaaatctgatcattaagtattgttttccatatcatgacatatagtggcacctctactttttaagtcattagatattatgctgtatggtagtactttaattatttgtgatcatttatgttatttctaactttgagcaactaaaactagagccttaatgaacttatacgtatgtctttgtgcacatgcatatgtagataagtatttccattaaaacgacttgtaagtgtgcatttaaatttcttttttcttttttttttgaattgcattccaaaaagacttgtaatgtatatttccttattgagttgtagaagctcttcacatgtaatagatattaatctattgccttctgtttaagatcttcctcattccacctttacaaaaaacattcttatgtgttttcttctggtacttttaataattattgtgtttcaatcttttttttttttttgtgacagagtctcactctgtcactcaggctggagtgcagtgttggatctcagctcactgcaacttccgcctcccgggttcaagtgattcccctgcctcagcctcccgagtagctgggattacaggcaccataccatcgcacccaactgattttttttttttttttttttttgtagagacggggttttgctatgttggccaggctggtctcaaactcctgacctcaggtgatctgcctgccttggcttcccgaagtgttgggattacaggcgtgagccaccgtgcccagcccattgtgtttcaatcttaatctttctggaattttttcatgcctggtggggataaaagagttttaaaatagttttgctacagaaataaaatacaggtataaaaatatttggccgggtgcagtggcttacgcctgtaatcccagcactttgggaggcctaggtgggtggatcacctgatgtcagcagttggaaacagcctaaccaacgtggtgaaaccttgtgtctactgaaaacacaaaaaattagctgggtgtggtggtgcacacctgtagttccagctactccggaggctgaggcaggagaattgtctgagcccgggaggcggaggttgcaatgacctgagatcaagccactgcactccagcctgggcaacagaacgagactccatctctaagtaaaaaaaaaaaaagaagaagtagtaactagatttttctgttcattggtatttttattatcttactggacttcagtaaacgtctttattttgttttccaggttcattgttttatctgagaataatagtaacttcagtcacttttctatggttacaatatttaaccttttttttttttctttttctttcttttttaaagacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtggctcatgcctgttatcccagcactttgggaggccgaggcaggtggatcagctgaggtttggagtttgagaccagcctgaccaacatggagaaacctgtgtctactaaaaatagaaaattagccaggtgtggtggcaggtgcctgtagtcccagctactcgggaggctgaggcaggagaatcgcttgaacccgggaggcggaggttgcagtgagccgagatcgtgccattgcactccagcctgggcaacaaaagtgaaactctgtctcattaaaaaaaaaaaaaaaaaggataggcctttatgataacttctgtagttaacttctataacctattcaggaatccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctacttttctctttattttgctctcctgctttttttttttgttgttaacaatgttaacattaagttaatgttaatgttattaattcttaatgaattcttagttcctttaatgtgttttcgatgagcggtaatcgctcctcggatagacctcattggctacgataccgccactgtgcaaagctagttcattttaatgtcttttaataataaaaacctttaatgttcttaatttgcttttgaatgcagcgttggctgcacattctaatttacatggacaatgttcttctgctcagtattttccaaatagctggtggttctagttttgatttcctctttgactcaggaggtatttaggataattctattcactcatattttctttcattgttgtcagcttctataatcttttaaaatatcttttaaacttattgagtgtttcttgtgacttaaaacataatccattttggaaaatgttctatgaaaacttagaacattttctgttggtaatatacagagttttatacataacctattgattaaatttaatgactaagattatttgtatgaattaccagtttttataaatagttcttactaaatataggacttagtctttattagtcctagtaagaactatagtcgttattaataattcttattaatgtaaaaatcttcctaatctgccaaagacaaagaggtagcattgtttctgagaagcttgttctcacgttgggacctttagatttttatttcttctgcctgaatgtcactgaggccatatttgaaagagatctttcatgatcacctctgcctacccccactccgcatctaacttcctgcccttcagtgtgtttattttcctttatagcacttccatctgaagtttctttttcatttatttggttttctttaatatactattctgttttacagagctttgaacaaataggtatgaaataagtatgtgttggttgagtgtcactctcttatttctaatgatttttagaaatttttattcattttaattaatagactttgcagcattttaggttcacagcaaaactgagcctaaggtacagagttcccatataccccatgctcctcatgcccctcttctccaagcctcctgctcatcaacatcctgcatcactgtggtatatttggcacagtcagtgaaccagcattcacacatcatcactgcccaaagcccacagtttacgttagggtttgctcgtatggtattgtacattcagtgggttttgacaaatgtataacaacatgtctccaccagtatcataccgactggtttccgcaccttaaaactctctgctccacctgttcctcccacttttactgcaacccctggcaaccgctgatccttttactacctccatcgcaatgccttttccagaatgtcccgtagttggaattatatagcgtgtagccttttcaacttggcttctttcacttagcagtatgcatctgaggttcttccgtgtcttttcatggcttgatagctcatttcattttagcactgaataatattccattgtctggatgtacattcacctattgaaggaccaggtttggtgattatgaataaagctgctgtaaacattgatgtgtggagttttttattgtggtgtaaaatacatgtaacagaacttaccatcttaaccattttgaagtatacagttcagtggtactaaatacatttatagtgtgcaattatcaccaccatccatctccgaaactttccatcctgcaaaactgaaattctatacccattgaaccataactcctcattctcctttctgtctgcatgattttggctactcttatgtaccttatgtaagtggaatcatattttgtgtttttgtgacttatttcacttatcctcaagcttcatctgtgttgtagcatgtcagaagttcttttcttttttttttgggtgaatagtattcccatgtgtgtatttaccttattctgcttgtccatttattcatcagtagacacttggattgcttccgtaatttaggtactgagattaatgctactacgaacatgggtgtacaaatacctctttgagaccttgttttcagttatttcgggtacatacccagaatggaattgctgggtcatatgataattctgtgtttcattttttgaggaactaccgtattgctttccacagcgcctgtatcacttcacgtttccaccagcagcgcacagcagttcagtttctctacatcctttttaacacaaccgttgttgtttttaatagtagccatcctaatgggtattaggtggtatcatgttagttttgatttgcatttctctagcagttagtgatgttgagcattttttcatgtacttattgaccatttgtatatcttctttgaaaaaatgtctattcaagtgctcatgtgtaggttttcgggtggacataagttttcagctgatttgggtgaataccaaggagcatgatggctggagtgtatggtaagaatgtatttcattttgtaagaaactgttcaactttcttccaaagtggctgtaccattttgcattcccaccagcaatggatgtgggggttcctgttgcttcacatcttttccagcatgtcatgttatcattgttttggattttacccattccaataggtagtagtgtttcattgttttctgttttttttttgagatagagtcttgctctgttgcctgggctggaatgtagtggcacgatgagaactcactgcagcctcgagctcctaggctgaagcgatcttctcacctcagcctccagagtagccaggactacagatacgctaccttacctggctatttcttttttttttttttgaaacagagtttcgctcttgtcgcccaggctgtggtgcaatggcatgatctgggctcactgcaacctccgcctcctgggttcaagtaattctcatgccttagcctcccaaatagctgggattataggcgcctgccaccacgcctggctaattttttgtattttttttgtagagatgggatttcaccatattggccaggttggtctcgaactcctgagctcaggtgatccatccacctctgcctcccaaagtgctgggattacaggcgtgagccaccgtgcctggcctatacctggctaatttttaaaatctttttgtagagacggttcactctgttgcgcaggctggtagatacttcttttgcagatattttttttctaagtctgtggtttaagttctcattctcccaactctgatgatttctgtcatgttttgattcagtattatttggtacgtgtgtaaattctacactgctcaagatcttcattatgaattgtacctcatccatgaaaatgattgtcctgtacgatcatgatttaacatttttgcatcttatattttgcttgtcttaaattcctgttgtactttgttttttgttcaataaattattcaacattatctttccttgctgttttttgttgtgtctttttaaaattgcgtgtagtttatttttgctttattccaaagtgaatgcttaaaacatattaatgcttaaagcattaaaaatgaatgcttaaaacctaaaataaagtttaaaaaaaaaaaaaaccaaaacatgtttattataataaatgctttctggtatgtttctgttattttatttaatgctttctgttttttaatgattaattgttgctttttttaattgttgtaaaatacatgtaacataaaattaccatcttaaacgttcttaagtgtacagttctttggcattaagtactcacgttgtggtacaactttccctaccatctgtcttcagaatttttttcatcttccccaactgaaactcggtactcattaaacattaactcctcattccctacctccagcccccagtagcctatctctaatctgttttctgtctcaatgaacttgcctcttctggatatttcttataactggaatcgtgcaatgtttgtccttttgtgtctcgctcattatttcatgtagcgcagtattttcagggtttatccattttgtagcatatagtataggttgagcatcgctaatctgaaaatccaaaatccgaaatgctccaaattccagcactttctgagtgctgacatgacatcacaagtggaaaattccatatgtaagtacttaatgcaaaccatgtttcgtgcacaaaattatttaaaatattggccaagcatagtggctcactcctgtaatcctagcactttgggagggcaaggtgggtagattgcttgaggccaggaattcaagaccagcctggccaacatgctaaaaccccgtctctactaaaaatagaaaaattagccagcgtggtggcacgcacctgtaatcccagctactcgggaggctgaggcatgagaatctcttgagcccagagggcggaggttgcagtgagcccagatcacaccactgcagtccagcctgggtgacagagcaagactgtccccccaaaaaacacacaaatttatttatatacatatatatatatatatatataattcaggctatatataaaaggcatttatgaaacacaaatgaatttcttttttttttttttttttttgagaccgtttcactcttgttgcccaggttggagtacaatggcgcagtctcagctcactgcaacctcctcctcccaggttcaagtgattctcctgcctcagtctcctgagtagctgggattacaggcgcatgccaccactctcagctaatttttgtattttgagtagagataggatttcaccatgttggccaggctggtcttgaactcttgacctcaggtgttctgcctgcctcggcctcccaaagtgctgggattacaggtgtgagccaccacacccagccacaagtgaatttcatatttagatttgggtctcatccccaacatatctcattatgtgtatgcaaatattccagtattagaactctgagacagttctagccccaagcattttgcattttggataagggatactcaacctgtagtacttaattcctttttaagggtgagtaatactccattctatgtattataccacttttgtttatctgttcacctatcaatgttttctttttttgctttgtaaattgtatttggtttgcttttatctcagatatttggaatgtatacatcctgtttttaaagtatattagcttaagtgaattcaagtctaaatctaaattgaaaaaaaattttctgatctgtaagcctgaaaaagaaaattgttttgactcttcctatatctgaagattataagatttttttctcttaaccctttctcactttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagagaaaaaaaaattttttttttttttgagacggagtctccctgtgtcacccaggctggagtgcagtggtgccgatggctcactgcaacttccgcctcccgagttcaggcctgaatagctgggattacaggcacccaccaccacgcctggctaatttttgtatttttagtagagacgaggtttcatcatgtgggccaggatggtctcgatctcctgacctcgtgatccgcccgcctcagcctcccaaagtgctgggattgcaggtgtgagccaccgcgccgggcctgagaaaaaaatcttataatcttcagatataagaaggttgcccagtttggagtgcagtggtgcaacctcagcttgctgcagtctttcaggcagtcctcccatctcagccgcctgagtagctgggactacaggcacatgccaccacacccgcctaatttctgggctcacgtgatcctatcttcctgccccagcctccctaagtgctgggattgcaggtgagagccaccacacctggcctaattatttcttttatctcgctaattacatttagtattaacacaagttattgaaaccttgtttatgtgaattcattgctcattgccagctttctgttttacatttaaattcattagtcatgtataccatctagtgtacattttcagctagtattttcactaggagtacctggaagccacatttaatgatttagattgctaacttccctcagaaattctgttgatgttgttctatcgccttgcattaatcattttgtttttttcctgtgcctggatggtggtaggaattttcctttttctttttttaaaaatattttgacagattctgtcttgtacatgttcactaatgttgcctgaaacattagttccttatgatctttgtacttggtgctttttaaaaaatttccaataatacttttggtgattacttttgtttcaattgttctgtttccttccttgaaaacacatgtaattattaggttggctcaccatttctgtcccctatgtgaactgctcaaaagtttgcccttttttaccactcgtttgatttttctttttcacttctaatgttggctttatttctgctattgcaatcttaatttcttagtatccttttaaaatttatctcacttttcttaaattatcttatctcatcctggtttcttctctccatatactcctgttttgtgtcatttgctaaattgtgactggaagttcctgaagtaatttaccttgtaagttaggttctgcttttgtgtgaagggtaatcttccttgtggttttcttttgctattaggatcagtgctggatttcttactgcctacttaccattgaacagtaactgttatgtcctgtctcatgtgcatttgtcagagatgtgtgtgtgttttccttgcctctccaggggactggagttctgatgaaaccgcttctcagatgtatttctgagggataaatacacagctcccggcctgatttccagtgatgaacagacattcctcttcatatggtattctgggctagggtagtaggatcttaccctaccctgtttctgtctttgtgagtctgaactgatgatgtatgagagtggccctcatttctagcatgtgctgctgttacaggttttctgattctgatcttacacccacaacataacactctccttgttacttcactaaacctcccaggaagcagtgtgtccattcgggttttcctgcccttacacagccccgctggaaccttacctgcacacgggcgcagacacacacttcctggtttgctttctggaatttgcgcctggtaatctccctgaatgtatgttgagagatcacagaagataaggaactgtggctgccacaaaaactgcctctgtgtagcaaggagtggctgaccaattcttgattctgctttgattcttcaaagccgactctgagtctccaaataaagcgatggctagtagggagagacaagatatcttcatagttcttttaggcagatgattgaactttgttttatgaggcagagcatggctgggtcacgagtctttttgcagtacagttgaccttaaagctaattgaaatccttcaaagatctcatataaattgtattggtggagatttgggacagactacgttggagatttctgatttgatagcattatttactagagtaaacctgttccaattttttgaaacttaggtaatcacttaagtagtaacatcagtcttgaccttcatcttttaataaaagattttacctcagattgatagattttcactttggtagtaggagaatggtatcttgttccattttgcatctgtttgataaatctagtgaggctgaaaatttttcctatgtctatggaccctccctccccatttttccattttgaattgctatttggggttcatggccaaaattaggaaaaactagacttcagagtgtttacgcatttcttcttccgacttttttttttttttttttgagatggagtttggctcttgctgcccaggctggagtgcagtggcacaatctcggccctctgtaacctctacttcccgggttcaagtgactctcctgccttagcctcctgagtagctgggattataggtatgtgccaccacgcctggctaattttgtatttttagtagagatggggtttctccacgttggtcaggctggtctcgaattcctgacctcaggtgatccgcctgcctcagcctcccaaagtgttgggattacaggcgtgagccactgcacccagacttcttctttttttttttgagacggagtctcgctttgttgccagcctggagtacagcggcatgatcttggctcactgcaacctccgcctcctgggttcaggcgattctgctgcctcagcctccttagtagctggggttacaggcgagcaccaccatgcctggctaatctttgtattttcaatagagacggggtttcactgtgttggtctggctggtgttgaactcttgacctcatgatccgtctgccttggcctcccaaagtgcagggattacaggtgtgagccaccgcacccggccccttccaactttttaagtaatctttcttgttgctgacttgttgtctccctgttccctaccgtcaggcagttttgaagcattttctgagcctcgccacttgacttcctttacgctttgtcattgtttcagttttttaatgtggtgattgagtgaaagccaaggggaagaagaaaaagagaaaaaagggtcacatttgaattacaaaatgcctttacactccctgtgtcctctgtatatagataccttcctctctttctttgcctgacaaattccttttcatccttcaaaaagcaattctgggttttttttgcctaattactctcatctaaacaggagctccgggtccccctttccagtgcgttccactgggccctgtcagcagcttaactcatttcagagtagttgttatttgtgagctccaaactgagacttaactcttttaggcacttaataaatatttgaatgaatgaataaattaggagtattagtaacaaaatgcttgggctgggcgtggtggctcatgcctgtaatcccagcactttgggaggccgagctgggaggatcacaaggtcaggagttcaagaccagcctgcccaatatggtgaaaccttgtccgtactaaaaatacaaaaattagctgggcgtgatggcacgcgcctgtagtcccagctactcgggaggctgaggcagaagaatcgcttgaacccgggaggaggagattgtagtgagctgagattgtgccactgcactctagcctgggtgacagagcaagattccatctcaaaaaagaaagaaagaaacaaaatgcttattccttggtgctgcaatgaaatagcactcagcataaatttaactttctcagcaaggcagttttacttgctgcataaagggtgctcctcgcagatggaacaatggtgagagcacacctgaacaagggaggggaaggggttcttattcctgacacaggtagcccctattgttgtgtcattcccctgttggctagggttggactgcactgtctaagctaattccgattggctattttaaagagaccagggggtatgagccagagtggcaggctgagtagtttagtgggaaggacggttaggaacaggtaactcaaggtgacttaggtcagagcaggtgaccaggggtgactcaggtcaaagcaggtgactgggatgagtcaggacagagcaggtgactgggggaacagatgtgaactactgatgaaaactggtggaaaaggttgtttagtgaaactacgctgaagttaaactttaaaatggagggcaatactggttctttgaagagaaatctagaactcactgtatccaacaggagagatttacaaagagtttctgttattttttccatccacgtcatttccctgcttagtaacttctagtgtgaaaatatcaaaagcaggtatctctgagaagtggacttaggcttattcttcttttcttttagaccttattctggtttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaagaaccatgagaaggttttaagtgggaggatgaagtgatagtatttttattttattttattttagtttattttattttgagaaagtgtctcgctctactgcccagggtggagtgtaccctggcatgatctcagctcacagcagcctccacttcctggttcgggcgattctcatgcctcagcctcctgagtagctgggacagcaggcactcatgatcacgcctggctaaattttatatttttttagtagagacacagtttcaccatgttgcccaggctggtcttgaactcctgacctcaagtgatctgcccacctcagtgtgccaaagtgctggcattacaggcatgagccaccacacccgtccaaggatgttaatttcttaaaaagggaaaaacttacacatttttattctcgtatttttctgtcactggatagaaacattactagcagagtaaataatccagatgcctgtcttcagcctttttgtcagacatgaagagtaagcatagaaggtaggaggcatggctgtgaggtcgttgaagtgatcttttcctgaacacagcaaatactataaatggtttttgtcaccattgaagtagtcccattgagagactgcctgattatcccagtgatgcttccactcttcagattatttctagaactcttctttttgcattgccctgggagcctctggcatattcttcagagtttcttcttcaccagaggcaaacttttcatccttgcctgtgcctctgtttcaggtcagtttctcttgctctctgcatctatgtttggcccaattggtttctttcttttccttaaaaattccttaaattttaaaaaaacagatattcatatacagtaaaattcaccctttaaggtatacagttaagtggttttttttgtttttttttttttttttttttttttttttttttttttttgagatagagtcttgctctgtcacccaggctggaggctggagtacagtggcgtgatctcggcccactgcaacctctgcctcccaggttcaagcaattcttctgcctcagcctccagagtagttgggactacaggcacgcaccaccacgcccagctaatttttgtatttttagtagagatggggtttcaccatactggccaggctggtcttgaactcctgagctcgtgatctgcccgcctcagcctcccaaagtgccgggattacaggcgtgagtcactgtgcccagccagttaagtgggttttttaagtgtgctcacaaagttatacagccgtccccactatctaattacagaatatttgcaccacctcagagagaaatactgcactgaatagcagtgactccttatttcatctccccgccggccccaaataccactaatctattttttgtctcatgaatggaatgatacaatatgtggtcttttgtgactggtttctttcatttaacacagtgttttcaaggtccatccatgctgtggcatctctcagcacttcattccttttacagtcaaatggtattccattgtatgggtgaaagagacagggtcttctatattgtccaggctagtcttgaactcctgggctcaagtgatcctcctgcctcagcctcttaagtagctgggatggtgcacacctgggttattttcagttttttgtttgtttgtttgttttgagacagcgtcttgcactgtcgcccaggctggagcacactggcgcgatctcagctcactacaacctccgtctcccgggttcaagcaattctcctgcctcagcctcctgagtagctgggattgtaggtgcccaccaccacacccagctaatttctgtatttttagtagagacagtatttctccatgttggccaggctggtctcgaactcctgagctcaggtgaaccgccggcctcagcctcccaaagtgctgggattacaggtgtgagccaccaagcctggactctgagtatgatttcttacctcattgttcatatttctacagtgataagtaggcatcatccatgtgcagccgcattatgggcctgtaaccatgaccggtctgtgagtttgagcagtttgaatgcataaggatgcattcttatgctatccaaattatttgtgctttgctggtgaagattctgaaacaaggtgtgtcattagaaagtgtttacttgtttataacggccttaaactactgaaggtgtataggatatttatgagtcgtgattcaaagtgtgagtttaaacgtttgttggtgcctccgtgttaaaagcattatgttagatagtgtcagataggtacagagatgtatggaaagtgttacctgccagccagtttataatcttgtagaaaaaagaaaagttagggctgagcacagtggctcaagcctgtaatcccagcactttgggaggctgaggcggatggagatcaggagttcaagaccagcctgaccaacatggagaaaccctgtctctactaaaaatacaaaattagccgggtgtggttgtgcatacctgtaatcccggctactcggtaaggctgaggcaggagaaccgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccacctccctcccggatggggcggctggccgggcggggggctgacccccccccacctccctcccggacggggtggctgccggacggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtcttggccgggcagaggcgctcctcacatcccagatggggcggcggggcagaggcgtcccccacatctcagacgatgggcgcccgggcagagacgctcctcacttcctagatgggatggtggccgggcgcagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaacctcgtctccaccaaaaccagtcaggcgtggcggcgcatgcctgcaatcgcaggcactcggcaggctgaggcaggagaatcagacagggaggttgcagtgagctgagatggcagcagtacagtccagcttcggctccgcatgagagggagaccgtggggagagggagagggagagggagagaggagaaccgctttaaccggggaggcggaggttgcagtgagccgagatcgtgccattgcactccagcctgggcaacgagagtgaaactccgtctcaaaaaaaaaaaaaagaagaaaagttagaagccaggtgactgaatttcaaggaagtgtgcaagtaccatatggatggatgggactgtatcattctgggtccaatcaggagagagaagccatacagtaatttgaacatgaaaaaacataattgactgactataacagggtaattgagtaatgagggattagccagtaaaaaaatagagctctaaagaacattggaatagcaaaagtaagaagcagctacttcccctagggctgagatagaccccccaccccctgcctgggaaagagctattccttttcccagagctgagatccagaccttattggagagagcgtggttgtaaatcactgaatggcagagatgtttctgccatttaatggttctttgttggccatagttgttggacatctgccctttagggtgccaaggagaattattaactctgatacaaaactgctcaaaaagagtatgtggggtggctccctgttgcagtagactcagtgctgctggccaccttcccctattggagtctgatgctggaggagctgcctgcccatcaggagtcttgtgacaactggaaccaggaagcaaaactccttttcttctgtgatgtctctccagcgccctatatcgacaaagcttagcatcgtgtcccggcaaaggaaaaatgcttgaaggcctcagatccgttttcggaatggacagaaatgatgaatttggaatggagaggcactagatcagtaactggcaggagaatggtattaactgctgcgggagctcagagacggagcagaggtcacatgacagtaaaagaagtatttgagaaagagcttagaagatgagtagatttttaaattgaagattgcttacgttttcatggcaaaatagtatctgcattttagaaaaaatagaatatagacaagtattattgtctattttctatagaaagaaaggaaaggcactcagatcactgtctacaaagagatccagtgttaattgcttgataaaaggtgtctggccaggctctgtcacccaggctggagtgcagtggtgtggcacgatcacggctcactgcaagctctgcctcctgggttcatgccattctcctgcctcagcctccagagtagctgggaccacaggcgcccaccaccacgcccggctatttttttttttttttgtatttttagtagagatggggtttcaccgtgttagccaggatggtcttgatctcctgacctcaggtgatccacctgcctccgaaagtgctgggattacaggcgtgagccaccgcgcccggcctgctgctgcttttgtatctttgcagaaaacaattggcttttaggtgtaataatgctaaactttataaacagacactgggaaaaacttcctacttttggtatttcaactgtgaagtttatttgcataacttctttatgataagtttgtcaaataaacattttagcgctcttcaagtgacctttaggaagagattttctgatggaacatcgtatcttagaagtccattttttcttgccaggcgcagtggctcacacctataatcccagcactttgggagaccaagacgggcagatcacttgaggtcaggagttcaagaccagcctggccaacatggtgtgaagccgcatctctactaaaaatacaaaaaattagccaggcatggtggcgggtgtctgtaatcccagctactcgggaggctgaggcaggagaatcacttgaacctgggaggcggaggttgcagtgagccgagattgtgccactgcactccagcctgggtgacagagcgagactctgtctcaaaaaaaaataaataaataaatacagatagaagtcaactttaaagctaatacccaatttctaatttaatttaatttaattttttaaaatagcgtcttgccacgttgcccaggctggtctctaactagtgggctcaggcagtcctcccgcctcaccctcccaaaatgttgggattacagctgtgagtcactgcaccgaccccaaattttcttttcttttctttctttttttttttttttttttgagacggagtcttgctctattgcccaggctggagtgcagtggtgcgatctcggctcactgcaaattccgcctcccgggttcacgccattctcctgcctcagcctcctgagtagctgggacactacaggcacccgccaccacgcccagctaattttttgtatttttagtagagacgaggtttcaccgtgttagccaggatggtctcgatcttctgacctcgtgatccacctgcctcggcctcccaaagtgctgggattacaggcatgagccaccgtgcccggccttttttttttttttttttttttgagacagggtctcgctctgtcacccagactggagtgcagtggcgtgatctcagctcactgcaacctttgcctcccgagttcaagcgattctcttgcctcagcctcctgagtagctgggattacaggcacacaccaccatgctcatctaatttttttgcatttttagtagagacggggttttgccatgttggccaggctgggctcgaactcctggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattgtttatttgaaaaacacattttgagtttctgtgatgtatataacactttgctaggtgctccttgagaataaaaagagctataaaattagtatcttctttttttttttttttagacggagtcttgctctgttgcccaggctggagtgcagtggcatgatctcggctcactgcaagctccacctcccggggtcaagcgattctacctcagtctcctgagtagctgggattacaagtgagcaccaccatgcccacctagtttttgtacttttagtagagatgaggtttcaccatgctggccaggttggtctcgaactcctgatctcatgatccgcccgcctcgacctcccaaagtgctgggattacagacatgagccaccatgcctggcctcttttttaaatttttatttttatattttcttctcaaaacttagtaccttctcacaaagagtagagttcagtagaggaaatatgatacatcatggtagctgacaatagaggcataacctataaataatagagctaataacccggtcataatctggttaatgagtgtttgctaactgtgtaatacatataatacaaaaagttaccattatagataccataatctctaaagatgtaagaacagaaccagtgccaatttacattcaattctgttccgtattttggtcttcatttaattgtaaatgcaaataaggtgcatatgtcgtctacaaagcaaaaaagtacaaggattttcttaagtgatcagtggatggctatcttactacaagcagtattgttcattcttcataagctggtgattttatataatttacggagttc

SEQ ID NO: 760 - DNA, 85740 bp, Homo sapiens
atttaactgagagtttaccaagatttcatcagtataccaaagaaagactttctggcaccctctagagattttatttttgtctctaaataatcttcataatgttgttcatattttagtattttcaaatgaaacaactcttcacaacttattgtgagacttgagattggacaagcccgagacacaattatactagtaagagttttcactgtcaaatttcttattctaatattgggaagcagaaatgattacatagttttagggggaggcgtaaagatgtaggatatttcctacagaaaaatctattcattcttttttattattatcacaagttctgggacacatgtgcagaatacacgtgccatggtggtttgctgcatccatcaacctgtcatctacattaggtatttctcctaatgctatccctcccctagccccccacccctcaacatgccctggtgtgtgatgttcccctccctgtgtccatgtgttctcatggttcaactcccacttatgagtgagaacatggggtgtttggttttctgttcctgtgttagttttctgagaatgatggtttacggcttcatccgtgtccctgcaaaggacatgaattcatccttttttatggctgtatagtattccatggtgtatacgtgccacattttatttatccagtctatcactgatgggcatttgggttggttccaagtctttgttattgtgaatagcgctgcaataaacacatgtgtgcatgtgtctttatagtagtatgatttacaatcctttgaatagatacccagtaatgggatggctgcatcaaatggtatttctgcttctagatccttgaggaatcgccatactgtcttccacaatggttgaactaattgacactcctattaacagtgtaaaagcattcctatttctccacatcctctccagcatctgttgtttcctgactttttaatgattgccattttaactggcatgagatggtatgtcattatggttttgatttgcatttctcaaatgaccagtgatgatgagctttttttcatgtttgttggctgcataaatgtcttcttttgagaagtgtctgttcatatcctttgtccactttttgatggggttgttttttttcttgtaaatttgtttaagttccttgcagattctggatagttgttgggaaaactggctagccatatgcagaaaactgaaactggaccccttccttataccttatacaaaaattaagacagattaaagacttcaacataaatactaaaaccataaaaaccctagaagaaaacctaggcaataccattcaggacataggcattgacaaagacttcatgactaaaacaccaaaagcaatgccaacaaaagccaaaatcgacaaatgggatctaattaaactaaagagcttctgcgcagcaaaagaaactattgtcagagcgaacaggcaacctacagaatgggagaaaatttttgcaatctatccaacaaagggctattccttctaaaatctgtagaaaactaacatttgttggagacacagggattcaatagtgttatgcttatctgtccaaaacccgtatatagtaacaaaaaaagcaaaaggtagttccaagatgtttacagtgtttatggcagagcacatttatgcacaagaatttaaaatttaatataatgatatgactcaaaatgactcaaattgatactaaaagatgaaacagttatcccaaaacatagctgcattttgcacatcaaataaggcagcatgcagaggttaaagtacagcagatctgctcccaaacctagttagtggatatacagagacacattctggcagggctgaggttacttgccaccagcccctttatatttatctttcaaggtgaactggatcacaaagagattttattgaccgtctgtgagtttaccactttatcataatgttaaaatcaataaaaacatgttgtgtataagtcacctctccgttctgaaccaattaagaaatatcagatggaattataaagatagcatccactttactgctagtggagctgaattatcaccttgggctagataccaaagcagctaccctgctacttcactttctgcgtgggaatttcccaactggacaaggggctggaatggagtccacccctttgacacctgcccaaggtggaggcgacaaggaggaaatgtgcagcttcacagtagccttgcatcatgcactgaccttcaacacatccattccatcccaaagcgggaccagctggtgacacaagcccccactggtgacaaggaagtaaaagtaatacagagggagcctagaaaaggcaatctaatattactacctgcaggggaatggcagtgatggggaaatcaagtgccctcacaacacagacatccaagccctactattcagcagtgaatgaaatggtaggcatatttacagccttagtttgagagcaaagaaaaacaaacagaaacgctggaattgattaaacatgcattgaagtcccatcctagttttaagttaaaatagcaacttttaatgataaaattctctcactcttatgacctctttgtgagaaaaaattgtgagaaattttaaataacctctgcactgcaaaaaaccacagcagtaatatcaaatatcattgaactagtaaacataagatagcagtctgaggggaatatgtgccagaatccccaaaaccgcagaaagtaccaaatcctctatatacactaggttttttcctacacacacatacctatgataaagtgaaatttatagttaggcacagtgggagattaacaataactaataatacaataggacaagtatgatataccagcatcgctactcttgtgcactggagccattattaagtaaaataagggtgatgtgaacacaagcactgccatatcccaacaggggaccccatcaccaagacagttcataagtgactacagggttgcagggagcagagacagcatgcattccctggagaaaggggtaatttacatcctaggtgggaaggaatgggacagcgagatttcagcatactactcagaatgtcacctaagttaaaacttatgaattgcttatttgtgtaattttctatttaatagttttagaccacagttgactgtggataactgaaacctgaaaattgaggataagaggggactactgtaatgtttaactcacgaaattgataccacaatcccttacccagatagcctgtactattcccaggtaaacaccatcattaattttcaaaggaaaatataacccagacatcttttaagttacatatgaaagaatggaaatgtaccagtgatgaggtgattctttcaaacaattgtgaaaaaaatacataaataatctaatcacaaattggtttgcccatgtagaaaacaaagaagaattctgacctcatatagtaatcatgactacatcctttcacttaagtggataacttaaaaataattttcctatggaatcacaaaacctctgtcccttcagaagcaaaggtttctaaattgttcaatcattctggtagaaacctttgttgttcagggtttcaaactctaagtacaagctagctgttagacgattatacgtagttcttcaacttcaaaactacctccctcttcctacaacctcaatctttgcttcctaacccctaattcactattgaatttttgtaagaacactgctatttatggttgcttctctgaaaatacataattcaatttgaaatattcataccctgggaaagaaaactgctgcccaaagcattttacacatttgggattaatgaatataatggactgaatctttgtgcttctctcccacaaccaaatccatatgttgaagccctaactcccaatgtaacagtatttaaagccaggggcctttgagagaaaattatattcagatgaggtcgtgagggttgggccctcatgatgggattttaccgtccgtatagcaggggaagagatgtcacaactctgccatgtgagggcacagcaagaaagcaactgtctgcaagccatcaagaacccaaccctgctggcagtctgattttggacttcccggctttcagaactgtggggaataaatactgctgtttataagtcacccagactacggtattttgttatagcagcaccagcaaactaataaagtaatcttgaatagactcaagactatactaggaagattcaataactcatggagtttcccctccataaatcaagaccagaaagtaatcaaggttatcaagaccaaatgttggttcaccagcaagtttgcttttgcttccacacaatctcacaaggaatatccttgataaggaataaaacagatgaaattgtgaagaaagtgtataaattctctaattttgtaacagctatagcatgactaagtaacattactaaatgactcccatttataagatcttcaacctggtgctattcatacaaagaagtggaagacacgatcattccctatccatggtcccttagaatatgggcagaatctgtaatggtatgatttcagatagataggtagaaaaagaggagaggagggaggaggcaggagggaggaggcgggaggcagcagggaggaggtgggaggcaggagagggcaggaaaggcggggagaggggagagtggaaaggggagaggcgagaggggaggagaagagaagagaggagaagagaaaagaaaagagaaaagaacgaaaaaggaaaaaagattttatatataatctttcaacttgggtcaaaggtgacttgggtcaaaacacaattcacagagaagaattccatctaagagtcagcaagtctaacatttaatcatagggttaaaatcaatataatcatattcgcaacaaattgactgtgtatgtatacacatgcacatataattaaaaagcacataaatatttaaacaaaagagaaggattactttgcaagggaaataaagctgggagaaatagtccagtagcctgatctgggtaaaagactgcttttaaaacacaccacattattaaatgctcttaaaagcatttaataatgatgtagattgaaaaggtgttcaaagctagcattgtttaagtttatacattaggcgctttaattggcattgagttataaacaatttctaaatttcgttatctcaatgttaacttttaaaagtaattttaaattattattataaatcaaacatgaaagaaataagccacatttaacatcatgacatttagtccagcaaacttgctgaattcccttgttaattatgacagttaagaccttagagtcccttgaaatttgtaagtaaatattatctgcacatagttttaagcttttcttcttgttcctgcccatgcttcttatgtctattcttattttatagcaatgactgaggttaaagaagtgctgttagcagatattcttttatttttgtgtcagaaatgggattataagccttagatttcagtattatttagcctaagaatgttttaattcctggttcactaagagatactaattaagtctgatattgaaatgtatcgtttttaaatgtgaaatatgcatatttgtaataactgattttcatctttctttcattttactccattgccattattttcctaatttcttgagatgagtacttagttcactaattagcagttattcttttctaataaatttccctctgtgtactaaactagctatattctttgagttttgctatttgctgttttaattggcatccagttataaacagtttctgaaattcattatgatgtctcaaagttaacttttaagagtaaacttcttagaatcatcattataaatcaagcctataagaaataagcatatgtaatttttaaaagaaccatattttgaaatataagcacataatttttaagctgtgttaccaatatttgaatacgcttgaagattaactctgatatttaaagtatctaatattgagaagctttcatttcatattactgcctaattcacagcaagaaaatcaaggtttgcaaaaaaaatttcccaccttcaataatgatagttgtcgacagcaccatcaccatcatcatcatcatcatcatcatattctaccaagaggtatcatttctctttaagacaaaatataagactatcaaaatctgaaggacaaaaagacttttctttcatttgggaagaagtgctatagaacaaagagaggaaaaatacaatttcaaattattaacatcaagtttcattaaactatatataaatccatctaatatataaaaatatttaagtaccaaagagcagcatgcaaaattctgagactttgtatatggcagaaacaaataaatatatcttgtgtataagaaaagaaatgtagaaggcaattatcttctactcaagctttcttcttttgaaagtgtggtacagaatagcttaacaattttgtacacacacacagacacacaaaggaacagaaattgtaaaagcaatcagaaacactcaaaaatgtgattatatcctttctagtttttcattttatatttgaaaaactatagcggtatatattaacaaatgtggtatacaattttatatataaataactccattataaatattacacattttctggctctgatccctaaagaatttcttctacctcttctttactctctctcctcaccaagatgtgttatttcttacaaaagtttgctggcttgtctctgggatgagctcccaagagacaaggtcaggcccaagtaaggtagggttcacaggagcccaagaaacaatagcatttgtaccttcagtttacttcaaatcttcaggatagatcaatacatagagaaaacagatgcaaatgtttggcagtgttctataccccagatctcaaactgaatacaactgcaccagaaacctgttctaaggcttgaacagctgggaaagtgactagatgttatttccggaatcctgagctgaagtttgcagtgtaagatccactgaccgtgaaattcggtgtctacaccttttcaggttattatttgctaagagtccttgctgcttcatgcacgttagcagtcactcactgtggagactcactctagtccagcctcaaaccttcccacaccatatttcctgagacaccaacaaagaaaaagcatccaaagagagaaggaagcatgtggacattggggcaccatcatttgcaaggtggggaagggagatggggcctcatgggagtttcgctgctagcctggatgtctcaaattaataacatttttcatttctgtgtctgcaattgcactggaagcttttacagggttcttcaaggcctcctcgctctttgattgcctctgccagctccagccgccccacatggcagagctgcctgcagtgcagcctgtggttaccatggagacagtaccccacggaagagaaagggtgaggcagatgccaagtggcaccgcagaacatgattgcagcaccacggagccccaagtactcgggacagatgtgtctatgaaaggagaggaaggtggagggatgacagagcagcagagctgtggggcagacaggctacgggagacagagggagatacagttaaaattgtcaagtgtttctggatatgattcactgtttctaccaaaatgaaatataaaaatcagaatttcaagtgtattaaaaaattaaatgtgtgtatatatatatatatacatatacacacacacacaaacatatacatacatacacatatgcctgtgcatgggcatatacaaaatacaagaaaagtttgatttgccttttcttaacatctgggaacagcatttatagaaaggttagtttccatggaaatctcaaaaaccagcaagatggctctggagcatgctaccattttatttgagcacattattgtaataatatttccaatcacaattcacatcctattctgtaccattgataagcttttgacattctttttctcttatacaaaaatctcgtttctattttatgtacaagaattatgaaacaagacttttttactaataaaaactataggttcgcaaagagtagctctcaaaatgaaagtatatatatgctatccaattctcaaagtacacaaattctcaaaagtacacaaaatgctttttctatgatgtgggtagggctgttctccagtatttcatttcttcatcctctgggcatatggaaggactggacttccctctcccttcagagctgggcatggtcacatggcccactcggcctgacgaaatagggacatacgactcaattttccaggttatttccctatctccatggctatggaagattgtgctgagatggaggatccactgtcctgggttctggagtcaccacaactgtcaaactctccattcaactcttgccaatccatgccaaaaatgtaccaacttttactcttgtgggctgctgaaaccgggaattatttgttaaagcaacctaacttaattcatcctgatacacaaccccccttattcaattataaaatattttcatgaagacattatgctcatgtgtaagaggggcccagaaatttataacatattctcttttcagggtctgccaagttaggaaatgattactataaaaggtaatatgtgaaatattccataataaacggaaaacaaaagttctgtaagagttcactttgggcagaggttaagactagaatgattaacacaacaaagtgcatttaagatggtaattttaaagagttaataagtcaagaagaaggccttctatcacaagtcaggtgtgggggtctatgacatggaataaaggctcaactactactacaaccactactactgctactagtactactactactaccactactactactaccaccaccactactactaccactactactgctactagtactactactactaccactactcctactatcagcactactactaccactactactgctactagtactactactactaccactactactatcaccactactactactctaccactactactgctactagtactaccactactaccactactactaccaccactactactaccactactactgctactagtactactactactaccactactactatcaccactactactactctaccactactactgctactagtactaccactactaccactactactaccaccactactactaccactactactgctactagtactactactactaccattactactactaccaccactactactaccactactactgctactaatactactactactaccactactactactaccactaccactactactgctactagtactactaccaccactactactaccactactactgctactagtactactactactaccactactactactactattatcattattattaaagggaatgaattgtagatgcccttgtgcccaagaaactctgcatggataaattaacttgattttttcatttaatttttaattgccacctaagaattatacatatttatggcatacacgtgctatttcaatacatgtatacaatgtgtagtgatcaaattagagtaactggcatgtccatcacttcaaacatttattacttctttgtgttgtgaacattcaaaatcctctcatctagctattattgctaactatagtcaccctactgtgttacagaacactagaacttatccctcatagctaaatgtaatgttgtactcattaaccaacttctcagtatccctccctccccactatccttctcatcctctggtaaccactattctactctctacttccatgagatgaaattttttagctcccacatatgagtaagaacatgcggtgtttgtatttctatgcctggcttatttcatttaacataatgtcctctaggcttttccaccttgctgcaaaacacaagatttcattctttttttatttattcattcatccatcaatagacatttaggctgatatcatatattgtttattgtgaatagtgctgcaataaacatgagaacatagatacctcttgaacatactgatttcctttcctttgtatagatactcaaaagattgctggaccatatggtatttttatctgtagttttttgaagaactgccctactttcataatggctgtactaatttacatttccaccgacagtgtaaaagagtttcattgtctccacattcttgccagcatttgttatattttttctttttgattatatccattttaactgggttgaaacgataactcattgtggtttcaacttgaatttccctgatgattagagctgtagatcattttttcatgtacctgttagatatctctatgtctttttgattatttgcccatttttacttggattattattattatcattataactgctgttgagattcttatatattctggatatttactccttgccagatggatagtttgcaaatattttcttccattctgtatactgtctcttcactctattgattgtttcctttactatacagaagtttcttagtttaatattgatatgatcccatttatgtatttttgcttttatttcctatgcttttgaaatcctatccaaaaaatctttgcccagaccaaaatcatacagcatttcaccaatgttttcttttagtagtttcttagcttcaggtattacagttaagtctttaatcagtttttgagttgattcttctatatgctgagagacagggttctagttttattcttctgcagaataaaggataataaataataagggtctagtttataccgaagaatctctctcaacatatacaaatatatatatatagttttcccagcagcatttattaaaaagcatgtattaaaaagattgtcttttcccccactgtgtgtattcttggaacctttgtcaaaaatcggttaaccagaagtacatggatttattttggtgttctgtttcattggcctatgtgtctgtttttataacagtactatagcttactacagtactggttactatagatttatagtatattttagagtcaggtagtgtgatgcctccagctctgttcttcttgctcaggattgctttggctacttagagtcttttgtggttccataaaaatgatataattgttgtttctatttctgtgaagaatgttattggcattttcagcatgattgaattgaatctatagatttctttagtagtatggacatattaattttaacatattaattattccaatccatgaacatgggatatttttctatttttgtgtcctcttcagtttctttcatcaatattttatagttttaattgctgaactatttcacctgctttgtcaaatgtattcctaagattggggggtttggtagctattgcaaatgggattactttcttcatttctttttctgactgctcactgttgggcatataaaaatgctacgatttttttattggtcattttgtatcttgaaactttactgcatttatcacttattttattatacttcaagttctgggatacatgtgcagaatgtgcaggttagttacataggtatacacgtgacatggtggtttgctgcactcatcaacctgtcacctacattaggtatttctcctaatgctatccctcccctaccgccccacaccctgacaggcctcagcatgtaatgttcctctccttgtgtccacgtgttctccttattcagctctcacctatgaatgagaacatgtggtgtttggttttctgtttctgtgtcagtttgctgagaatgatggtttccagtttcatccatgtccctgcaaaggacatgaactcatcttttttatggctgcatagtattccacggtgtatatgtgccatattttatttatccagtctatcactgatgggcatttgggttggttccaagtctttgctgttgcaaacagtgctgcaataaacatacgtgtgcaagtgtctttatagtagaatgatttacaatccttcggttatatacccagtaatgggattgctggatcaaatggtatttctggttctagatccttgaggaatcgccacactgtcttccacaatggttgaactaatttacactcccaacaacagtgtaaaagcattcctatttctccacatcctctccagcatctgttgtttcctgactttttaatgatcgccatgctaactggcatgagatggtatctcattgtggttttgatttgcttttatctaatgaacagtgatgttgagcttttttcatatgtttgttggccacataaatgtcttcttttgagaagtgtctgttcatatccttcacacactttttgatggggttgtttttttcttgtacatttgtttaagttccctgtagattctggatattagccctttgtcagatgggtagattgcaaaaattttctcccattctgtaggatgcctgttcactctgatgatcgtttcttttgttgtacagaagctctttagtttaattagatcccatttgtcaattttggcttttgttggcattgcttttggtgttttagtcatgaagtctttgcccatgcctatctcctcaatggtattgcctaggttttcttctagggtttttatggttttaggtcctacgtttcagtctttaatccatcttgagttaatttttgtatgaggtacaaggaaggggtccagtttcagtttcctacatatggctggccagttttcccaacaccatttattaaatagggaatcctttcccctttgcttgtttttgtcaggtttgtcgaagatcagatggttgtagatttgtggcgttatttctgaggccactgttctgttccattgctctatatatctgttttggtacctttttggtggtgtctttaaatttttctaaatgtaagatcatgtcatctgccaacagtggataatacgacttcctcctttccaatttggatgcactttatttttttctcttgtctattcactctgggtagaagtatcagtactatcttgaaaaaaagtagaaaaagtgggtatccttctcttactccagatattaaataaagccttttaactttaacccattcactatgatgttagctgtgggtttgtcacatactgcctttattgttttgaggcacgttccttctataactaatttgttgaaagttttttatcatgaagtatgttgagttttatcaaaatgtttttcttcatctattgagataatcatatagtgttttgtccattccgttgatgtgatgtaccataattaatgatttgcatatgttaacccatctttgcattttgggataaatctcacttgatcatggcgtataaaagcacttttggatgtgcttctgaattcagtatgctagtattctgttgaggatttttacatctatgttcatcagagataatggcctgtagttttactttttgttgctgtttccttgtctggttttggtatccaagtaatgctgacttcatagaatgagattggaaaaattccttccccttcaattttttggactagcttaaaaagaattgatatttgttttttaaaagtttgaattcagccatgaagtcatccaatcctgaactcttctgttttgggagactttctattactgatttaatctcattatttgttattggtctgttcacgttttccatgcaaatagaaaccacaaaagagcagaagtagctacatttatatcaaagagaatacactttgagtcaaaaactataaaaaagagactaacaagatccttatataatgatctttgggtccattcagcaagaggatataataactgtaaatatatatgcactcaacaccaaagtgcccacttatataaagcaaatattaatagatctaaaaggagatataggctgcagtataattcaacagtctactttcagcaacggacagacagaaattcaacaaacaaacactggagttaaactaccctctgaaccaaacagacctaactgacatttattgaacatttcatccaacagcttcagaatacacattttttttcatcagcacatggaacattcttcagaacagaccgtatgttaggccacaaagcaggtatcaacaaatttttaaaaataaaatcatatcaagtacattttctgaccacaatggaataaagctagaaatcaataaaagaggaactttgaaaactacaaatatcatggaaattaagcaacacggttctgaacaaccaacgggtcgatacagattttaagaagaaaattttaaaatttattgaaacaaataaaaatggaaacacaacacaacataccaaaacctatggaatacaaaaaagcagtacagagaggaagtttacagcaataaatgcctacatcaaaaaagtagaaagatttcaaataacctaaaaatgcacctcaaggaaccagaaaagcaggaataaaccaacccaaaattagtagcagaaaaaaatgtcggagcagaaataaatgaaactgagacaaaaatataaaatatcaatgaaacaaaaagttgagttattttcaaaagataaataaaatgacaaatattttgctagactaaacaagataaaaagagagaagaaccaaatagtactttgtttatctggttatttaataaccaaataaaaccagaaatgaaaaaggagacattacaactgataccacagaaatacaaagggtcattcaagactactatgaataactgtatgccaaaaaaattggaaaacgtaaaagaaataaattcctagatgcatttaatctaccaagattgaaccatgaagaaatcaagttcaatttggttttctgaaaaacaacaaataattgtttagtataagtgtgtcccatgcaatatttggaacatacttagactgaaaaaaaaagtatggtttatataaaattcaaagtaaagtaggcatcttgtatttacatttgctaaatctagcaaccctaactatgtgtactttctaagaattacacgggttgtgtaaaagggctggtgagggggcattaaaagtttatcttcagattatcagtaagatgattcataaaataaagagtaattacacatttttggccttgtaaatggaaagaagatagcattcccactcatttgttaaaataatttccaaacatgatgaaaatgctctttgcttctataaaaagccattctctaaacaaaatacctgagcaattttacaaatttcaagttatgtttcttttgattccaagccactatcaaataagatgttttctatcctactgcttttttttttttttttttttttttttgagacagagtctcgctctgtcacccaggctggagtgcggtggcgcgatctcggctcactgcaagctctgcctcccgggttcactccattcttctgcctcagcctccccggcagctgggactacaggcgcataccgccacgcccagctaattttttgtatttttagaagagatggggtttaaccatgttagccagaatggtcttgatcttctgaccttgtgatccgcccgcctcagcctcccaaagtgctgggattacaggcaggagccaccacatccggcctattctactgctttttaaaaataattttgagtacttattctccttcccctcacctttgccaaaaatccatgacataactgataaaaatattttaggctgatttgctatttaattagaaatcaatttgaataataattctaaaatattaggacatagtctaaccccactaaaatcaaacaaaaacatcgttccctttacagagatctttaaaaactttgagcaagcaaaaaaaaaaacttctagtgttaaaaattaggttgtaaaaaataaataaattttatcttttaggacctaatttctcctattataagcatcttagattagtatggcacatttgttataattaatgaccagtattgatacattattattaactaaagttcatacttaattcagatttatgtaattttccctaaagttcttttactattccagggccccatccaaaatgccacaccacatttagtcctcatgtctccttggactcctcttggttcttagtttctcagactttccttgtttttgatgcctttgacagttctgaggcatactggtcaggcattctgcagaataaatgtcttccacatgattagactgaggttatgggctttggggaagaagccacaaaagtaaagtactattttcaacacattgtatcaagctatatataaagtagatttttttaattgacactttttatgaattgcttactcatatccttggatgctaaattatattttaatgctttcaacctggtattaccagcatattcaatctgaagtaaacatttggacaagacttgagggcttcaattttataaatgaatggcattcttaaattaattctaacctcatttagaataatcatatgacatttcaaagtgcaaaaacaaaatgttgttgaaacttagaaaatggaatattgtaaacattagaacattacatctgtcctttaattaagcctagtgtagcttaaaggccaaagttacaaccttacgactaggctaaaagacccaggaaaggtagaatggttgacgaagataagagtatttccctgtggcagagagtgactgcgtgcaccccattccccagggccaacgtactagcctgtgggctcagggacttaagctaattctttccagccttgccaaccttaatccaatcaatggtttcccccatgacctaagagttggcacatctcccttagtatttgaaaacacaagagaattccaatctcttatttgtcaagccaccaaatgaagaatttcagggggaagaaaggaatacatgttatttttcacttattaatcagctcctccattgaggagagtgaaaataattagaatagttatttttatagatcaaacatggttacctgttagaaatttcacatgatcctcctacctactacttgcaacacagcaatgtcggcctggttgtgtatttttcaagttctcagaatgactctttttttttttttttttagatggaatctcactctgtcacccaggctggagtgaggtggcacaatctcagctcactgcaacctccgcctcccagtcccagttcaagcaattctcctgcctcaatctcctgagtaactgggattacaggcacgtaccaccatgcccagctaatttttctatttttagtagagacagggtttcaccatgttggccaggctggtcctgaactcctgatctcatgatctgtccacctcagcttctcaaagtgctgtgattatagatgtgagtcaccacgcccagcccctagaatgactcttaaatagaaaccttttcacggcatgtaccaaccttggtaaataatcagatgaaggccccttttccttctttctgtaagactcaaagccaaaagctggagtaactagacagcatgcagaatgtcaaccatgcagctgaagatagggagaaggggccagaatgccaccttccactgagctctgagattatctacacccagacacaccacaggtaacacattttcagttacaaaccttcaaatgtctctctaagactaaactgagttaatgattttaagatacaatttagagcagattcaaacactaaagatgcacaactatgtagccaattcaatgctccaagagagaaacaactcattctaaattagtgtttgagtgggtagccacaattaaacaccaaagggcaactaccttaaaatactcgttaggccaaaggaacctccccagtctaatgacacatttgataacttcaagcatttctgtgtgcaggtttatatttcaaagacataattcactaaaggcacagctaatttaaataagcaggggatttcatgatagtggagtccaaacaggaaatattaaagtttataaaagcaatacttcattttatattaatataaattctcagatacagacatttcttatatgagatgaaataaaagtaaacacagaattactaaaatatcactcttgaagtcacaagaattcacttctaacattttattacattgcaacttttaaaactccatatcccaaacacattaaactttcttctttataaaggacatcacaatgttttcaacctttatcactcaaggtcttatgccaaaattagcatctgaatattttatagtcttttaaaatattctacttttcttttagttgacaatattccaagtcatagacagtaccttcaatttaaagataatgaaaaatataaattcactttgagaaaataaatctactttcataattatatatgttgtgtacttccaattttgccattattcatctatactttctcattataatatcttgaaaaagtagcctgaaaattcccatcagaatcaactttttcctgcagttcacagtccactactttttctgagatgctgattactggtccctgaaaacttaaacttggtacagttctatttcttggttctatattggttcatattaaatcatgaaccaaaagtatagtctcatatatttaacatatcctcctgccacaaaaacctgtcacagctgtatttatcatgagataacctgcctttgaaagacaacctgctctctctgaggatgccaggacatccatggcagctgaccagagaggcaaaaagcactatattacacctgtacatggaaaggcaggcagctcttacaaactcatcttcatattgatctctcacatcccttcagatagactatccgtcttctgtcttgtcttctcatttcaacatctatctatgatatgacttgatgaattaaaattttatccttcataaggcagctacttagatgccaggtatgcattaatgcttgtcagttcctatgtgtactatatcagtaaatgatcaattttaaagtcattttaatgatcaaccttcgaggaggttgcagtctaatggaaggagacatggaaacaaacctgtaaaccaacaaataaatgagatgatttctatcactcatatgttatgaaaaagataaaacagggtaactgttaggacagaaacacttgctttcgcaggatgatcagcagagacaggcggccaaagtggctagagcctaataaacccagggacagagaggggagataagataaaatagaaagaaactggaccttttgctggttgtcaccactagggttataagctaaggcaagatgtgggtgaactagaaggagccctaggacggctgtaggaatgatgagctcacagtgggttggccagccaggagcctgctgcagaaaccctggtgagcaatgagacagctggatcagcctcttaacactgaaggtgacaagaagtgggaggttcaaccaagatgaaaagcatccatgcaattttgaaaaatacacttaaaaaggaactctggaatgccatatgttaataaatacagacatgtgggtctaggtactctatataccatattgttctatgtatcacattctgaattttataaatcaaagcaaaacatttaaactgagctgaataatcacttattaataaaatagctcaaagagcttcatattatccatcaggaattatcattcatttagggagtaattcaataccaaagttccaaaatctgccaccagagattggccttccttgacactgggtaacttgctggtttcatcctgtggtctctgttatagattgaatgtttgcgtcttctcctcacccaccaacaaagtaatatgatgaagtcctagcccccgatgtgatggcatttggaaatgggacccccggaaggtaattagtgttagattaggtgatggggatggggccctcaagaagggatcagcagctttctaagaagacagatgagagatctacaaaaggccatgtgaggaaagagcaggaaggcggccatctgcaagtcaggaggagagccctcacctggaatcaaatctgccagcatcttcattttagacattccagcctctaaaactgtgagaaataaacgttgtttaagccacacaatttagggcagcctgagccaactatgacagtcttggaaaaaatttggtggaatccttccaaagccaggatgcactatcacttgacattggacaagtttttctgaacttctgagatgacagggaatatagtatgttattaaatttggaaatatttatgcccttaggaaatatttatgcccttcagtgtggtactcaattatccactcagtgctacagcacagtctgtgaatctgttgtcaaaacgtcctaccatcttctcttggtgattcatgaacagcttcacaaattcttctgacatcataatattctctataacatcacacatctgcacatcacaaaacctgacaccttacattgtgtctatatttttaagcccagaatgcacatgcagcttagcttgtcgatgatggtgaacttttccacatgcagcttagcttgttgatgatggtgaacttttccacatgccaatgatttcatgcaaagagtacatatagcaccagtgctgatactgggatgaatagcctaccttatttgtcttctcgatgccttctaatcaatgtacgaacagtcctacatttctccaaatgaccataaatatctatcttcaaagctatgctgacagtaaacatgaaagtaacaatgctctactaatatgaaaaccattcagcagacaaactgaaattacttctgtagtagaactaactatttaacataagtcctgggtacacatattgaaaattaataagctatagcaaagaagaaatattttccctcataatccacaaagcaatttgctctaaagaataaaaagaaaaaggaaaggcaatggacagttgtgtaagcatcaaagatcttgagagaaactgccaaaaaaaagacaaaatctcttcggagttagacagcaccttctttgggccagagctaaaaaaaaaaacctcacatagccaccaaatcccagcccaccacatctcaattagctaaaatgataaataactgtaaggaacagcatgtatatttaaaatcagatgaatatcacctaaggatattccaagaatcagtgaacacgacgaaatctactactggtccaaaaatctgttacattgctttcaaaattcttatcctccctttcaagagataaaatatgagaaagcacttgtaaagactaacatgctataaaattctacggaataactttgcttatatttcctcccacactctgttcaacttaagacagcactttacccagccctgtcaccagctctcccacttgcggctctgcaccgcctgccattctgtaggtctaactgcactactgtaaaatgcatgatttatcaggccacaaggaagccatataaactcatattattactctgtaaacatacagtatttatgtttactactgaaagatcttaaatcctagtagcaattaatgcattttaagagaatcggcacatggagaaagggaaggatttcagagatgtgatggaattaaggctgcacagccatctcagttggaaatccatgtttgaaaaggatagaaatagctacccttcaactagaaaaataaatgactaaaccattcagagggggacagattatctagcgctggaggtatatacatccagagcttgctgctaactactagttataacttcttgcctcatttaaaattaaatttgtccagtttgttgaatgaatgcataaatcaataaacagtggactcgcccattataatagttctgtttctaaaactagtttaagctaccttgcacctttccacttcttgaaattcctgcatttaccaggtattaccaaactcccagctcctagctcatgaaaacatcctcagcttccacatccatcgcctatatttgcaaaggaagaaggatgctttctgaacgttaatttcctccagccatcatcttggctctatcctctcacactccgcttctgtcctaggtccacaggctaagtacaagctaagtacaccccatggatcccctcaactgctgcaacaggaaatatggtgtcactatacaatttatcacacaacccatgctaaactgctgaaagaagacttttgatttataagatcatatctgaaattgctataggcagtcagcaaaacgaagattagcatcccctctcaagtacctaaaactttgtaactcactaagtaacatactcattgaggaatgtttaacttgacttctttacttccttcaaaagttttgggaatcgagaataaattagatttctgtaacttacacatgatttcttcctattggcagactacagttagagcgataagaattctgtgcaatttgttcaaagtatttaaggaaatatctcaaaaaatggaagccaactatggttcacacttctaaaactgttctgataaagcctcacaggtgccagacgcggcagcccaccaagagagaaaataatattctggagacatttctacagacttcactcttgaaggacaatagggcttcattccactcccatctttaagcagcaaatatctgcaccacaaggaaaaaatacaagaaactttttgggccaattttgtataacttacaatatttgaagtggtatgaagaaacaacaagaattacttctacggatggataaaggagaattcttcctttaggcaatagccaatagcatgaaatgtagcaatatctttacaaccactatggaagtgggcattttataaacacattagtaacaaaattcagagatttagttttataggcaagaaaatcttttgactctaactcttaccccccaccattactgtatttttgaagtgcatcaaaagttccagagaatatattttatacttaaatgtttattatgattaagcttcccaaagcattttcacctaaattatcacagcacattcaacaaagccctgtgagtttttatcccaaggaacaaatgacaaaataggcaaagatgcaaagtcacaagagaaggcaagtgccaagcacgatttagatcccagaacttggcatcctaaggcagtggtccctccagggtgctgcagtgtctgtacccaaaaccaacccaaagcaagcaaagaaaccttggttcagaaaccatttttgccccaaatgatgaactaagtgtttgttacatgcctactactatcctatgatttgtggatcaattattttaaaagatagattaccagtatggggtggggctggggagaagcatggtcctatgtgaccagagagaaggagtgtgtgcctgagagcagggggagaaggtagaaaatcatgtgtttgcctaaaaacagtgtcctggctcttcccaacgaacttgaacttgagaaatgagacatccctgaagaacacacagtcaagtgccagaaccacacacaaagcactgcacctgtgagccccggactgccacaaacaccttgccttttcacacagtgatcctggagtctgtgcaggtgcgtttatgcttcatgtgggaaaagcaaacgccagaattacagaaaagcatctggcatctgtattatttcgcagtagaaacagctaatgtgtgttgtaatagtgaatataccacatactctgctatgtattttaagtccatggtctcttaattcaccgtcgcaacaacctgaagacacaggaattattgtttcccctgtgttatgacacttagtagtaaaataaccgttcacttagaaaatgatgaagttgggatatgaactcagtcagttggggtacaactttgaagctattttctcaaccatttgctccactgctgtatttactactgggacacacgaaatcagcaagcagtaaaatgtttccttaaagaagaactcctgtaggacaagtgagtaagtttaacttcaagctttagaattatgctcccaaaataggaaccaataaaatgatatataaactgttaagacatgacagagtgacataattactatagacaaacaatataaatcaattttaaaaaaggaaaatagataaattgagaaatgtgtataagatataaaaagataattcacaaaaaaattagacgtagacaccaacaaattagaaaatatttaacctcaggaatattaatagagaagcaaatgaattagagaaaaacacaatatttctcctatgtaattagaagttttatttttctcattacaacacccagtgttgttgaaatcatgggaaaatttgtacactcctgccttgctgagagaaatataaattatataatcttcctggaagacaaatgaacaacatatatcaacaaccttgaaaacatccagttctaggaagtaatctagagtaaataacctgatgacaactatttagttattaggatcttaattacagcattaaatataactaccaaaaatgaaaatgtcatcaatctccaataacagagtgatgtaagtaaataatgttatataaaggtatggaaaacagacactaaaaataaatactaattacatgagatgttaataggtaactaaacagaatatgagcaatgttttctaaatttaaaaatgtgtatcgcttgatatctctgctaaaaatatggtcatttctggggcttgcaaccatgcatgaattttaacttcttttaatcatttctgtatttttgaattttcaatgagcatgcactacttttgaaaacaaacaaatctcaaatttaaaggcgagaaaatgtaagtatggctgatcaaaatctgtgtaatctacattccatgatgaatgacctttgttaactttaagtcatgcattcagctaattaatgaacttcaccccaaaataaatatatactattcttttcaagaatggaaaggcatgcttttcttctgcataatgtaatatatatattaaactatgatatatttagtggaaaagtaatatataaagaacaaaactcttgaaaccctgacataaacactgtgttctcagtgttctcacatttgggagtgggtatgtgtgctgggtatcacattcaatatagttatttgccttgattatcttcttagctttagtattatgaatagttctcatataattagctactctgaaactataattcataattgcatatttctttggctagaggtgccataatatatctatgcacctgctatgaatttaacattactctttttcaacctgagttaagcaacacaaataatctgatccagatgctacaagccccagccttcctgcatcaaccttccatgtcctgggttaatgagacaatttgtactatctctgagactttttatataacacctgtctgtctttctggaggattcttcttccttatttggtttccccatgaccccaagaacaatgctccacaccagtgaagactgtgttagagatgagagattgaactgtggctcttttacatttggagctaccaaagaggttgctctttctggaaattacattattgtatactgttgaaggtaatgactgctatattagtctaatatttgaaagtccaaataaaatatgtgacagaggataaaatttgttttaaaaagtgagcatttttagattgagtagtcatgcttagacttaaatacaacatcgtatctatttagaaaagcaatgtttatcttctttctttactgtgtccatgatttctcctattaattgcaaaacatcaaacagccaccaaaatctaattatttatactgaggcagaaaaagctgtggaaaatagctagcctagatcacttatatatggtttgggaagtcagattttaacatcatcttttttatgtctaattctcaccacttacaaagcgatccaattattggcagttaaagaataacatgaaaaataggggaagaacgccaagggtaagttattttaaagttggctatacataaatctgctgaatttcatggaccatagttgctacaaatcaaccagggcattagacgctaccttgataactcttgatgtagtgtcaaaataccatgaaatatttaaagagctcaactaccaagcaaagtactgtgaaagctactatatccagaattctatcaactagaattcttcataaaccatgccaatggggaacacttcttctctattctgatatttcctttcaggcaaagggaacttaattaatgtaacactgctggcctctctccagcttttcactttctctgcctctgaagaataaagaagcagcttgccttgctgcttctctcttcctctggagatcatcctccctgcagagagcaaggcttggctctgccagctcagaaaaagctctgtccctgtggggagggaggagggaaagaaggcagaggacctgggatgtaattcaactgccacaccaagctatgtctaatcaaaactgatatttttgcccatggcagccaattatttatctttttcccttccaatatcccaacatgctgagatggggagtggggaggaggagagcttgatatttatttgattccttaaagacaccaacaacccacattcctgcacattttgtaattcttaaagtaactatatacctttctgtggtttatgtaattgcatatttaaatgcaaagagataatacaataaagcatttgtacattataaggaggtttctaaaccaaaagaaagaactgcataaaacatgcacaaaatgcagttttcttaaaatttctaatgacagttgtgataatcacatctgttaaaccaaaaatgttactaatacacttctctggcctttacctaggcaagagaagtgtattttctaatatcaatgatccaattaattgttcccccatcatctagtgttataaagtaaacatcctatttagtaacatttctgtatcattcaaaacttgtagaaatgttacatatatttatttaaccaaatataattggctcacctgcttactttgatccaaaaaaacaaaaaaacccagtaaggccttttatcataacatgtattttgctctggtaacttataattggcagttcccacaacaacacataaatttgaatacaaataaccacatttattgtaaaaatgtttttctgactgaagataaatttgtcccccattatacagctcacattctgaaacaaattccaagatacatcgaatcgtaattatcctaaaaattatgttgctgaagatcacagttctaaatgaagcccctctgggtttgatcatcccaaggagctggacatcttccaacctggaagagctgggcacttttttgtcttcactgaagctcttaagagtgaaacaaagcaaaaatgaccatctattttcaaagaggtaccaattcacacactttttagttctcttcaaggacttgattttaattggggagggggtcttccctttatgtaatacatttagctgtttaaggtttcttttttctctatcataatgacatgatgatgagattcatgctcggtggttctaaacagagcggatgtgtaatatctgacctcacagagagtgatgcttattaaactgtctatgatagtctttgtacaacattaatctttgtagaaaatttgatcttaatcaggtgactaatataacactaataaagaatatcaaagttttgtaatttctactgggttagaatcttttataataatggtgttgggagatataatttacttctcctttagcttaactgctatatactttaatatataaagggctggtatgtttcagaatagaaagtttagcatattttataagcaaatctgcataatgaagcaatattacaataggggttggggtagggaaattacagccatttaatatcctttgttagagaggatggtaacctagataacctatttaattagatatgtataaaacattagtacctgtcttaatatgtatatattgatttcttgtgttcacataaattttgtaatttacaagccacttatccatgctcttactcactttatcctcaaagaaatcttttaagatattgtgtcttattctacccattttacagctgaagaaactgagttaacaactgaggatcacataaatggtgagggatacacagctaagaagagacagggctggaatccaccaaaagccagtgctctctccacatctctgtacccaccagaagcagaatgcaaaacagcattacactagggaaacttatttttccaataattgtcatttcagatcacaaacatatttctagagaaatagttgggctctgacatataacgtgtttgtgtgtgtgtgtatgtgtaactttattacaaaatattgtaatatataatatataagaacccaataaaatgtttcaatatatgtaattcattttgcacgtaatgtgccaagagagacaggtgaatatttatctaagatagaaaggttctaggaagcattgtttcacttatttagtcattatttccaatttgtcaaaaactaattgatacaggtacttcaatatcctgacatagctaagacacttcctacaaatcaattaaccatgattcagagcttggaattgcacttaactgctatgtgatcaaaagataaacaactggaggtgtcataactgcagatttttgttatgagtcttaatatttaatggactaaaaagcacagtatgataaaatatttctgtgagttccctgtgttggaggtactgtttgtgactataactgagtttattaaacccaaccaggcagtttgttaatcagtaggctggattggcagacaatgtgatagaaactatttattgatgacatgtttaatattttatattaatataaaaagctgttgctttggcatataatcagataacttgaagctagcaacaagtatcatgaactgttcctactcaaattaacttttcacacaccagaaggctatcaaagtactgtggacaggagaacaccttcagaagatgaatgaggaaaaccatcatggaagccaacaatgaatttggcttggcagtgtatttccaacttgcaaatcagccagcaaagaaccacaccttcagctgaagtactggacttgaaaatgactagcagtccatgcttagtttttgttcattgtctgaattatgacatccaagtttaagtactcccaactatgttaagtcttttaaaaataaaaactctgttaggaaaagtgagactagcatcaaggatttccctctaagaagtgaaaataatgttcgcacagagaaaaaacaaaaatgggtgttcccattttctgtggctaatcataaagaagaaaacattggaagttcaaaatgtaacagtttctattttaattcaattggcttgttacagctgtatacactggtccatacatagtgtactgaccctatggacaaattacaataaattatttcaaatgtaatgttaatgttttcttaaagacaacctgatgaaattactctgaaaaccccttcgacaagtccacacaaattcataccacacaagaaagaagtctgataaggcaaaacagaaaagagcaagttctgtaacattttctgcaaatacactgcatattcaactaaatgccaaagtaatattatatttgagattataacttcatttttaattttagaaactattatgaaagcaatattatccttagaaattatttaacaaaactataaattgcatttgcaaactagtatttgaatttcatttttgtctctgatgaacaatttcactgggagaaagaattggcttatattctattgtgaaagatgtaaagtggatagaaatactgtaatttgacagtgtatgacttttattacgaacaatgaaaacattagtgacatctataatgactgggttatacaactacacaaacgtacaccaaattaaataactcctttccgcaagactatgacaattttattagggcaacaacctcacgtacttaccacaattgccattcaatcagataatatcattttcaatccacaatataacataaaacccacatatacagtatatgtagtttttcacatgcccatcggccgctctgggtacacacacaggcacagagcagtatcaactagtcctttaaaaatcatgtttaagaatgaaacactaggctcaaaaggaaaaaagaaaaggaaacgagacatgtatgctacttcatctattgcttttgaaagaaattttatattaaaacaatgcagtgggcataacggtgtgttcaaagtgctctcggaaagttccctgaatgtgaataaggtgaaactaaagcaatattgctaaagactaatcacagtattcaatcaacttgagccgtatagaccttgccagtcctcctgcaacactgacttgtgattagtgtaatcaaaggcctcccaaatttcaacacttaactccgaatgtaatcgtcttccttcaagccctgagcccttggaacccacagatcagtaatgatgccacttaacatttttccccaacaacagtaggaacattctccgtatggcaaccatatgctaataaaagacatttgagggcagtttaaagcatctagttcgtatttgaggatactcgcccctatatatcacacgtctcgtagcagaaatccccaaaataatgacaggttcaccgccataacttgatatgagtcacagcaaacacttctccatgggattttagaagtggtgcagccccgaagccttgtcattatgtaggtgaatgaccagcagcagagaccagctggactgccctcggtagcttcagcccctgatgaagtatgcacaatgagataactcctagggagtttcagcacctccttgttttcatggaagtcactgcagaaaatcccaagactcttaaatattggtcacatagttcttaaaagtgaaaatttacacctgtcaggcctaatactatgctgacaacattctctgttttctaaatcaacatatttgcttgagcacagtaaaaatacatcttaataacacctgccagagctaaggcgaatcagatcagctcaaatgaggcacacaagaaaagaaaagaaaaaaaaacaccttggaaacacaacctgcccctctatctctcatctcccacacccttcatacccccacggttacagcaaaatacaactttgggcattttggaagtaactgttatttgtgacacacacacacacaccccaaaaattcccaagtctgttttcctaccacaaacaccagggaggctgcatcacctttctagtgacttaattctgaaagcagaggctcaacctgccgagtggcaatcgaagaaaacacactacacaccagaataagatgagggtcgggaaaaaaagaaaaaagcagcttcgctttcagccattaattacggatcaccccaattttgcatcgctcatctcccatacacacgcacagccttccaaacctggctttcaggcggcgctttctggagcctggctgtctattgtcagcacgcagaagcccccgaaacctgtgaagccggctgcaaaggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagaggtcttctccacagcacctgcccaatcttgccatcaccttccctgttcagatggcatgtttttggcgggtagtgagggtttctccttaggcaaaatcacttcagatttgaaactggaatgtctgtaaacttcctgcaagaaagacccttgcccagtctggaacttgagcagattaagttctctctcctccccttcttgtgccaccttgtcctcctctcttggtatcttctgctgcatctctgccaccttctcttcctccttttcttccttatttcaaagtgaaccactcccctgatccttccccacagtcttccagtgcatctcgcattgccttcttcacgttcaaatcagttttccatatcacctcctggcttgactgctccttgaccccatcgggacttccccatgcgtagcctgctgtgaaatacagcaagtggaatcaccgtattcaaagtcttgttgaaaaacgaaacccaaaacatgtgccaaggaaggcctctgggccttcgcccctgtccctctgattcagcagcagtcaggacggggctcacgtctgctgcattcacaagccaagccaagcagggcacagcctgcccaggggccaggtcgaatgttcctcctaattatgccacgggcatgaccctgaacaccgcagactgtctgaggttgtgatctcctccaccccccccaccccccccacccccgcagagcttgtttctgaaacacaaataagcatgacagaatgcaggaaattgtaataaaagggatttggtgcttacgattctcagtaacattgtgcttctattttgtgttgaaagagattatccaacaaacttaaatgatttgaatattcaagtctattctttattatacttgggagtaagttgaaatataaatggaagtaagagtgaaggagaaaagcggtacagaggttaaataggtaacaaataattgctaggaggagcagattaagcagactattgacaacagtacaaatgttcgcttttattcctcctaccccaggtgtggacatgcacacacaggctttgtctcacctgcaaaaaacagttctccaagctaactccaagtgtcttaaagccagtttgatattaaaatatcctgagtcctgtgagggaagacatgcaagaccatttttttcatcacacgtttaattgtaatttttatcttagttctcagaaaggcagttcaattacactgagtacgtggtacaagacaaattagcagcaccatatccattaggccacattatatttcaagagatgttcttagttcccacctgagcttctgtcagtctgctatcgtttggttttctctttgcatcttctaactcaagaagtcagtggggaggtggaaagggagatgaggggacatcagttactctttagattaaaatggaggtagatgtgtagatgctatccacaggtaatatatgtgtcttttatgcctgatatagatctaagtaaagaaaataattttctaacgttttttagttactatcgagatgagcaatgacaaattctatcaactaattgtgtgtctgggaaatgagctggaggcagtccctacagatactgttggggctggggctggtgtgatatggttatttaggaagcagagtggtaaagtccaatgtcctggactgctttgatttcatttgctcagtgccccatttcattgaaacatttatgacttttattattctagaataatttgtaacttaagatattattcaattcacaattagataatattgaaaaataaagcaaaatgaacatgtataatgttagatcttggaacgactcactgctgccatcttttgcctcctgcttccgatagttcctatataaaggaatattctgaatcctcaaattcactatgagactagaacattattagtttattattttcaaattacagtactcaatgctcagtgaaaaaccttcattgtatttcttctgtttatgcattaatagagttatctgatacagaaatcacatataaatactaaatgctatatctcttgatttttcaaatcacttttcaaaatttgaagcaaacgtttttatatggaagtgtaacttaactttagaaataaaatctaacaattccaaatattttttataaatgtatgtgtcttattttgtaattcaaagtatgtcgattttaggagaatggcattcttatttaagtcacagctgtttcaatatggcattgtttgttgctattgagattcaaatagaagataatatttttgtaattttttaagtgaattacccattgataaacaattgagaaattttcaaattgggaaatgaaatcaggtgagtgattattgttgctgttcagcatttaaatagggagagtaatgatacttctttcaattcacaatttaaattttaaagcaaattacctgaaatagtaacccaatagtgtcatcataagtacatgtgtgtatatatttgggaggctaacacacactgtttgctcttgatcataaaagttatgatatttgttacctgaaagtatctctaagtttttgaagactgtaaagtagttaactaatttaaactaaccattttagttaagatcaacgtgtgggtcatttcactatttgattgcaaacttcacattttcactcaaattgccttttattattgctgcaactcctatgatggtatcattcattcattcagcaaatgtttattgagcatccatccgctgtggttcagtattggccaaaatttggagaattagtagcaaacaatagagaagacaacaaattccttatcctcccagagtttaattatgaattggggttatgggggaagcagaaattgaagcactgcagagaggtaatcaccaccagaagctgaaatgaggaacacaaatgtcctcatttcttcctaattgtctgtgtgcctcagtgtattggcttcctgttatgggaggaaagttcatctatattggattaagccgtggtggttggattctgttacctgcatcaaattcaagctcaaattgaaatatatgttatctgtaatgtctcccctctgctcactatagctgttattactgtatttcccccacaatgtatttccaaaaattaaaacattttttcaacaaagtgagtaaatgaatatggtctaaatcatatgtattagaagataaattaaggaataatataagaccagttttttattgtcactgaccaataaattcatgttcaaagcattgcacaatgagtccacctcaacgatttttatactgtctcccaaaatgaaatacctcattttcagtctttgttctccttaatgttctctacccactccagtgtcactctcaagtttgtacagaatacacgttctgaaattgatttactcattaaaatgaaatccttgaagctctcattttattacccataaataagccaaatcttgcctcttgctttgttgtgaaaattaaatgaatgaatcagtctatgataagcaaatggctctatgcctggcaaatagggagcaattagtaaatgatggtgaacatgagtcatgacattagaatatctctttcacctctgctgttttcgtcggcttgctatatcaaaacacacttattatctgattgcgcatatcttattcagtcatcaagacacctagaagataccattttgccagtgagctttttcatattcatttctttcaaataatcattaactaaatttctcctacatgcaggtaattatatcatgcagactaatcatgagaatttacagggatctccatttggtaaactggttgtgtttcatgctttcactgaatttttaggaatttgaaaatacatcacattcagattacagagtcaggtagcttacctttttgtcatatttcatcatgtctatatatttatatgctttgtctactccatacaatgtgttgctttagtttatatgttgataaagttatctaacattattttccatattctctgagattgtgtctatgtacatagaatatgtatgtgagcagtttgattttctatttgtgaagtatattatacttctataataagcaaaaatcaatgtttcacaaaatctttacacaaatgtactctaacatgaaatgttcaattatttgaaaaaatcattttcgttatgattctgcaaagattaaacatatattttgttaggaataggaacttaatgaatttttcaaatcattgagcatttcgtgttagagtatgtttgtataaatattttgttaaacatttatttttgcttattagagaagtaacaagttctcatttaaaaaactttaaaaatcagaaagttatgaaaaacataattctaccacccagaaaaagtatagtgtacaaatgcctatcctcttatttacttaaaattacattcctacactttcccattccatttctcaaacttttctaaggttagattattctttatataatgagttttctgttttatacattttgactgttatcacatgacctctcccgtggtaaataaaggttcaatgaaggttgttttctcaaattgtttgaaaagaaaaacaccccaattatatctatttctgagtaggatgaaatagcttatgggacctccatgcctctggtaagaataattagaatttttgaatgaaaaacaaaaatatttatcttatgcatcagaaacctgctgaagcaaaaaggactggaggagccaagattccagacaggcaagaatgtggatgccgagctaatgtggtatgtctgctttttccctgataacttcggccagttctggatacagtgagagaggctgggttttgaggcttttcctgggtagaggccactgtctgagacagagatatcagcagaatctttgttagcctcatagggctttagactgaagcccaagggatcaagatcccagtaagaagaaaggagcagagaactgggacagaaacatagctggcattcccttcaaagcttttgataacttataaagcttcacaggactaaacagctaaacaaaaagcctctgaaaatcagatataattttaacagtcctgctgtgcagagaagaaaagcattcacatccaggaccagccccaccttgggagatatttcaagttatcagttaaaactcctggagtgttgcaccctgagagctagagaaaacagaggtggaataaaatgtaacaatactgtaattgtctccaattcagtgatgttgctgattggaatagaggttaccaggtgatttatctgcctagcagaggaaagggtgaaaccttttaggcaaacctctgcaatttttaaatattcattgtccagcattcagtaaaatctgttcttcagagttaggagcaaatgaccaaaaaacaactaacaaatgtagaattggaaaagacccatgggtgatctatatactagaattagcagacaaaatatctaaaatgataatgaccaatatgtccaacagaatataggactgtagaaaaagatgaaaaagaaaaaacatgaaaaggaaaagacggagaaattcaccaaataattgaaaactgtgagaagaatgaatccactgggaatcctagaacttaaaaatgtggcaaattaatttagtaacaaattttatttgatccatcaaatataaaattgtatcaatccacatgtaacatttgacaaaatcagccatgtgctggattgtaaagcaagtcacaagcatgaaatgattgtattcattcagagaatattctcagagaacagtgtcattaagccagaaatcaataactaaaaaaaaagaaaatcttcctatacataatttaatctgcactacttcaaaataaatctacttgagaaacttgaattattttaacataaatgataaataacatgtgtacaataaaaattgcaagatgcaacaaaaacagtctttatgatatctataaaatatattatattatgtacaaaatatataaaaacaagttgcagacacttgacagcagccaatgtaaggctgctattcttgagctattctggagagacaaagtatttaaaagtcactccacttttgcactgcctttttccctaggtacattttctggggtgtggtacaagcaagatcttgcttccactgaacagagaaggcaaggattaaatctgggtttattaaagtgtctccaatgtggaagagacagtgctggaaaagaaagagtcatagagagggaaatccagaagtttacatagaaatgccccttgaggccgggtgcagtggctcacacctgaaatcccaacactttgggaggaaaagttgggtggatcacctgaggttaagagttcgagaccagcctggccaacatggcaaaaccccgtctctactaaaaatacaaaaattagctgagtgtggtggtgtgcacctgtaatcccagctactagggaggctgaggcaggagaactgcttgaacccaggaggcggaggttgcagtgaggcaaggtcattccactgcactccagcttgggtgacacagtaagacttcatctcaaaaataaataaataaataaataaataaataaataaaataaatcccccttgagccttgagtaacttgaagaaattgtggattcatgagagtagaacaagactccaagaagctagatagagaactgctgggaagcaaagaactgaggaaagatttcgcagcttcttcagtggtatggattttggtggtcaggcccaactaaagtgaagaatgtttagaacaagtcaaagatggagttgagatgtcagacatgccatcagatacaggtgttataaattgaatcatgttcccctcctaattcatatgttgaaaccctaactcccagtgcgcctgtatttggagatggggcctttaaagacataattaaggttaaatgaggtcataaatatgggccctaggccaggtgtggtggctcacacctgtaatcctagcagtttgggaggccaaggtgggtggatcacctgagatcaggagtttgagaccagcctggccaatgtggtgaaaccccatctctactaaaaatataaaaattagcctggcatggtggcgggcgcctgtaatcccaactactcgggaggctgaggcaggagaatcgcttgaaccaggaggtggatgttgcagtgagccaagatcacgccattgcactccagcctgggcgacagagtgagactccatctcaaaaaaaaaaaaaaaaaaaaaaaaaggaaagaaaaagaaaagaaagaaaaagggccgtaatccagtacaacttgtgtccttataagaaaggaagacaccagggatgcctgtgcacagaggaaaggccacatgaagatgcaagaaggtggtcctctgcaagccaaggggagagacctaagagaaacctaccctgccagcatcttgatcttggacttctagcctcaagaacagtgagacaataattctctgctgtttaagcactcactctgtgtcgttttgttatggcaaccctagcaaactaatgaaaagagtaaagataagtgcactttaggattgaggtctacaacctagaaatatgcgggggcggggggcgggaaatgtgatagatctctttgaagagagtgtaaaaccagggcttaacagctcaatttattccattagtactttgttgccaacataaaactcaatactttttgatggataataaatgaaatccagtgccttttcaagatattatcagaaaattgacaaatataattttaaaaaggaagaaaaaataaccaggttgtacaaagaaaaaaaaatctatcacaatgaagttgttgacaaccaaagattgaaaaagtaattcttgaaagcagctagagaaaaaagacacattacacacagaaatacaattgttacatacattggtaactcaaaagaatttatggaggccaggaaacagtgaaacaaaatcttttaaatacaggaaaaaagaatataagtgaaagaaaaaggaattcattgctagccgtcttgttctaacagaaatgtaaaaggaagttcatcaggctgataggaagagagcagaggaaaacttggaactttagaaattaaaaaagagcaacagaaatagcaaatatctgggtcaatataaaagactatgtttccctcttcaagtcagttacatatatataactgttaaatgttaaaattttaacattttccaatgtggcttttgatattcattgaaataacacatttagaaactgtaacaaaatgtcagttggtgatagttggtggtagggtagggtaaagggacttatatggttgcaagggttctgtataataattgaagtggtacattattaactctactaaccaataataaaaataatacaaagacatgtagccagaaaaccaacagacaaattgaaatagaatattaaatatactcgagtaatccataacaaggcagacaagagaacacagaggaagaaatgcagaagggacaaacagaaaaatgaaataaaatggtagacataaattcatttatattaataattatattaaacattaatggcttaactacttcaattaaagggcagatattgacagagtgaatgaaaagcaagatcctaccagaggccaaaaacaaaagcacagttattgaaagtaaaggatagaaaaagatctaccctacaaaactaagccaaagaaagcgagggcgtttatattaacgtcagataaaataaacttcgagacgcagataatgtaattagataaagaggaacatgtcgtaacgataaaagggttaaattatcaagaagaaataacaatttaaaatgcacatcccagagcctcaaaatacatgaagcaaaagttaatagaattaaagggagacccagacaatcatgcattgtaagagattttaacagccttcttgcagtaattcatatagtaaccagacaaaaagtctgattataaacaccatgttctttacctcctgattatacacaccattgtgtgagtccctcttcttgagtttaggctggacctagcaacttacttttactgaatagcattcatatatctgcagaaattataaatatccatagaaaactggattgatattttaaacctgaaattcatttatgaaagactgtagcatctattgcttcaattatttctttctggttcgtctagcttgatcgttctgatgaaacatcctgccatgttgtgagctgctccatggagagacccacatggcaaggaattgagggtggcgtctgaccaacagccagtgagcaactgaggctctcatcaaagagcccatgtggaactgcatcttgccacaccacacacacacacacacacacacacacacacacacacacacacacacgtaaacccggaagtgaatccttccaaaaccaagacatagttgactgcagccctggccagcaacttgactgaaacttgtgagagaccttgaatcagtggtcaagctaagccacactggaatccctgaaccacagaaactgtaaaataacaggtgtttttattttgttttgttttttgagttggaatcttgccttgttatccaggatggagtgcagtggcgcgatatgagctcactgcaaactccacctggcggattcaagcgattctcctacctcagcttcctgagtagctgggattataggcacgcaccaccatgccaggctaatttttgtatttttagtagagacggggtttccctatgttggccaggctggtctcgaactcctggcttctggtgatccacccacctcggcctcccaaagtgctgggattacagtcatgagccaccacacccagccaataataggtgttttaagtaacaaagttcaggtgaaatttgttacaaagcaatagatgataaatacaaaccctatcttgacaaagactacttcagtacttcaattgtaaattaatatttaaattaaaatataaattgtgtttgttgtttagttgattgatttaattttgaaattaaatttaagcactcattccaaaagcagtagaaaatatgaggcatatatatatataaaatataaatatatatatatataacataaattggatccataattcaaaatctttttacaaagaaactcaagacaaagtagttttaatagtaaattatctttcaaatacttaaggaagaaaattattctgatcttatacaaatttaccagaaaagagaaaaaaaaggagagcacttttgcactcatagtatgaggccaccataaacttgacaccaaagtctaacgtggactttacagaaaagcaaaaatatgagttttatctcataaatgtaaatacaaactcctaaaggaaataattaacttccaattgagttaacagatacattttaaaaatacattataaacaagtgaagtttatcttaggaaagtaaagcttttttaaacatctgaatgtcaactgccatattcaccacattaacagaataaaggagaaaaatcacagattcagagaaaagcttttaataacatccaatacccatctaaggtaaagaaagaaaaagcaatttagcaaactaggattagaaggaaacaccactaatctgatggttaactggaaaaaaaacacctgtagattttcctctgagttcttgaaaataagacaaagatgtctactatcaccacttcttttcaacattttactgtacatgctggccagtgaaatgaggcaataaagagaaataaagattataaaaatagaaaacatggagagcaggatgattctcccccaaagatctctacatccgaattgttgtaacataaaaatatgttccttatatggcaaaagggacttttcagatgtgattaaattaaggattttgagatggggggtttatcatggattgtccaggtgggccagtgtgaccacaagggtcactgtaagtggagagggaggcagaagagcgagagcgagaaagaggtggaagttcttatggtgctggctttgaagatgagaggaggaacggacctcagccaacgaatgaaagtggcccccagatgctggaaaggcaaggaaaataaattttccactagagtctccacaaagaagcagcgtcctgccaacatcttggctttagcccagtgcaaaccatctcgtatttctgatcttccaaattgtaagataatgaatatgtgttgtttgaagccactaagttagggagttatgggtaatttatcatagcaataataagaaatagatacagaagagattgtatgtgtacaaaatctaagagtctgctatcaaattcaatatgtgaattctcaagaacactggattcatattcaagacgtgtccattgtatttcgataaactcgcagcaaaatattggaaaacaaaacacaatttttaacgaacaccattcacaaaaaatattaaatacctatattgcatctaacaaggataggcaagatcttaacaatgaaaagtataaaatttgctgagaatgaccaaagaatttctacataaatgtaaagatattcatagttgtgaattagaagactcaaaattgttcagataaaattcttcataaatgtatctatacattcagtgcaacactcataaaaatccatggtgtttttaaacattgatatgttgattctaatatttgtacaggagtgaaacatgcccaggataaccaagtcaatcttggatttgaagaataaatttctaggatacacactactggatgcaaaacttattatataaatctacagtaattaagacaatgtgatatttgcacaaggatagaaaaaagacaaaggagtaagatagagttcagaaattaacatacatggattgtcacttgactcatgccagaaccatcagtgaacagcagtgaacaatcccaacagcaagatgaagactgtatgagtgaaatgcctttcctttgtgaagttggaaaagggggaaattttgagaggggagtagggaaggaaattatgctcttatatcacaatatgttgctgagaaaataaactttacagaaaaaaacatatttgatgttgatcatttgaaaagtgacttctttaaactgaatggtacccttgaaaattcagtgtgtgccaccacggtgatctcacacggggactgctggtttgtaatggagattcaggaacctttgtcagatctcaatcactaagttgattggtgagtaaatggatgttcttattttactctttttaacttatgaatagctgtacttcgatttaattttaaaattatcacgcatgtggttctggaagatttataatacataaatataaacataaactatataaagataaaatatgcaaaatataattatggaaataaataatagtaatgatcgatgtaattaaaatagctttgaaatatcaatattcctctatcaaatttgcaaagtcttcttcacttgtaatattcagtgttggttagaagggagagatgccaatgaaattcacatcatcaccacagttttaggggagagtttgcaatacacgttgagatcctgaagaacttaatctactttatggaaagtgatttttgaaggtctcattatgaagcagagcatgggaaactgaagtaaacctttcattgataactcagaccaataatatagatgttaatgtactgtgacaccatgatagcctcaggtgtcattgcagtgtctcttgacctgtattaaatgaccctagtctttgaacatttagctatcaccaagcaagcatctatctgtacaggccatttgagtgcttctgctttcaggattcccttccctgcatgcacacacatgtgtagtgtgatgggtcccctaccaggttacttaggatgtatacccactgcttgaacccaaaggccaggcattgagacaagaccctgatgcccagcagaggagcaagtgttcctgagaacttaaacatccctggagtatatgagaacctaccaagaaaaccagtctcatcacttaacacagtaggcaaagagccagaaaatcagcttaaaagtactttacagacaagaggcagcatagatctctagcgttgccctgctgttatccaggagcaccctgtatgtaagtcctaataaactttatgtaattgtcaagttggactttcccaagtaattatttggtctctcaacaccttcctcgttgcagaggtagaggggggtgtgggtgttatagccccaagtttctctcttaacaatatgcaacatcaagattcccatctgcttttgtaacagagtccctgctgtagtagagatcaagatacttttctgggacatttctagctttatttttgcaggatgtataaatacaatattttgcaaaacacttgaagacaaaaaagaatgtaaaataagaaagcaggatgattttgcagtgcaatggataggcaggttgtttaatggataagtatcaacctgaaaagaggactcagtaatttgtaagtagcctttcctggctttgtattttaagcctctacatttaaaaggaggcacatgatatcagtttgggaaaagaaagttgaagaattgaaagacagcataaagtctcagaacgtatttcaggagatagcgcagtggtctaaaattaacaagatgaaattcaatggagagaaatgcaaagtccttccttaggttaaaacaatggtataataaatccaggttaggaggctgtggattctgaactgggatccatgtaccagagctgcactggccgcgcccaggccttgggaacgtgggtgttcctggaatcagttgcttcccacttggttcaatctgttcagggaaatttccttcagtgcctacaagagaagattggcctttctaactactgcaagctgctgctaattttattcaaaggcgagtatcggagacaccagcagattccccacctgcctggaaagctgccttcatcttagtatcatggaacgagaagctgaagcaccaattacggtctgctgtgccaataatacctctgacaccacctggaacttcatttggagtcttccttattgtgactcagcactgccatcctcagctgcacagaaaattcaagccctctggtcactttgcttttcattatttgttaccatcttgcagctctgtgttcttctctggaaattttggctgaacataattaaatacccctaaattactttttgaacaaattagttttaattttattcttaaaaattcatgactttgtacaaattattaagagacctctgttcaggttgacatctattcattaaacccaagtttcatagttcttactctttttatatgacttagtgttgtttttcattaagcataaatcactcttatttacctatattgtttattcctcagtatactaaagacatggaaatgaacttaaatttcaactttaataaatgaatttacaataattgttgctctaaatcatgaatagtcaatcacaaccaaattgtgtttatttaattcagttccctttatttaaagctaaaaccttgagcctgggagttcaagatcagcctgggcaacctagtgagaccccatatctacaaaaatatacaaaaaattagctgggcatggtggcatgtgcctgtagtcccagctacccaggaggctgaggtgggagaattgcttgagcctatgaatttgagactgcagtgagccaagatcacaccactacactccagcctggctgacagggtgagaccctgtgtttaaaaaaaaaaaaaaaaaaaagttaaactctattctacctcccaacaaaaattgaacaacaggtaattcataggcctcttacttgaaacttatattacatgtatttcctgataaaattttatcagaactttgtttctctaatttacgagatggttttttcacctagattttagatttcaggtcattcagcttactatgcagaaaactcattcctgcatctgcttttactgtgttcacctctgtatttctagactaggttcttgtctaattcttggtttatccaatgtagctaccaggttagtttctagggctgccacaacaaaacaccacagactgggtggcttaaacaacagaaatgtgtttctcacagttctggaggctagaagtccaagatcaagatgttggcaggtctgattctcttgaggcctcgctccttggtttgcagaggagccttctccacgtgtccttccatggtcttccttctaggcatgtgcatccctggtgtctctgtgcatccaagctgtctttttctagaacaccagtcttattggattagggcccatactcacagctttattttaatataattatctacgtaaaggctttatctccaaacacaatcacattctgaggtaccagtgcttaggattttaacctatgaatttggcaggacacatctcagccccagacagctaccatctattttttgtagtggtatttgagaatttcattctcctttagtcagccaccctgcagttttactccccttgccggcgccggctgattgactgttcattccttcattcacttgctcatcaaatgccttctcaggggcaggccatgctccagggtctgagggtgaggaagtgtcactgcccttgtagcactgacattctggaggaggacaacaacagtaaacacagaaaccgacttttccgtattgtggtgtcagattgtaagtggtaaggtctctgaggaaaaataaagaaggaaatggggctagagatgtaagagtgctatttttgatggattgttcaggagacacttctctaagtagatgtcatttgaatagcgactggaataaagtgagagagaacactttatgaatatcttggagatgtgtctttgaggcagagggcacagcaactgcaaaagcctggagtaagattattcttagcaaatttaaagaatggaaaaaggaaagccaatgtgacagtcaagggatggataatgtagagcatttgagttacagaaaggtctctttgtattataagtcgcggggaagacttcggagagttttgaccaggggcaagttgtgacctaacttacccaacttagagcctcaatggagagttctggatgccgtgtggaggacaggtcacaagtcacagaaaggcaagaatggcagtgtgctgctaccctgtcagaccaggacaaagatcatagcaacacaggtgaaattgttacctgatatggttttgctgtgtccccacccaaatctcatcttgaattgcagctcccatgattcccacgtgttgtgggagggagctagtgggagataattgaatcatgggagtagtttcccccatactgttctcgtggtagtgaataagtctcacaagatctgatgatttcataaggggtctcccctttggcttggctctcattctctcttccccaccatcatgtaagatgtgcctttcaccttctgccatgatggtgaggcctccccagccacgtggaactttgagtccatgaagcctctttttctttatgatatacccagtcttggatttgtctttatcagcagcgtgcaaaggactaatacgctggtggtggagggaggagaagcaagaagtgtgaagtccaggaatctctagtaaaagcaaactgagtttgatggactcctctcacctgtgctaggaatgcaagccagcagagtgactttgttagtcctcatctttgtggtgtagccgaagattgagctcaaaactcttcctcctgccaggcaacagtataaactaaactggataaatgtgggcaaaagtgaaggaggtggcacaggagccagacctccctccctcaaggttgagtaaaatgatgctatttcagcaccttacaatgttgccaattgtccacagctggaggtaatatgagatgacatttctgctgggaaaaaaattctccatgaatctttacacatttccgcacagtcagagcatgttatattctgagcaaaagtgactctcaacctgggttaaagaatggtttaatggtaggcatgcctggcaagttagaaactccacgttgctccagggacagttgcttactttgtagcataacaaactcctttcttgactcccctggaaccgctggtttatattccagattagagaccttctcctcctctccttagagatgatttcttcgtattccagagacatattttatctctgtctctgtctccatttatctgtctctctgaaaaagaagagggacagatatgacagccacactaaatatgatctgagtttcataacactgaggctctcctcttctgcgtgtgcagggaagatcaggcaatcattgccttgcccctggagaaattaaggaatagggaccagcactaagatctctctgttttctgacccagagagcttgtatttcctatcaggatgaataaatagacattaaaatgtgacaaattccactgtgattcatccgaattaaaatgtccctgaattatcaaactttgaaacttgatacatccaatttaatgaatctggatagaaagtcatgaatggtcatggagggtgcaaaatcttcagaatacattattcgtacttacacaggccatatgtttggtatgagtgagatcatgagtaaaatatgttgggacacatcctgcaaactggaaagtgaagctgtgtagaattccatcaacataatgactatgtagacaagttcatgtactatgcaaaacattcgggagatactggtctttggtgtatgttatgggctgaagttggtctcattccttcccatccaatttcatatgttggagtcctaaccctcagttcctcagaatgtgactgtatctgaagataagaaagtggcaattaaagttagaacaaggtaatgaaggtgggaaactactaataggagtgatcatatggtttgactctgtgtccccactcaattctcatctccaattgtaatccctacatgttgagggaagacctggatgggaggtgattggatcatgggggcggtttcccccatgctgttcttgtgatagtgagttctctgactagtatttgattttacaggctcataggcggaagggacttgccttgtctcagatgaaacttcagacttggactttttagttaaggctggaatgagttatgactttttagttaaggctggaatgagttatgacttttagagactgttgggaaggcatgattggttttaaaatgtgaaaaggatatgagatttgggaggggccaggggcgaaatgatatgatttgactctgtgtccccacccaaatctcatctcaaattgtaatccccatgtgttgtgggagggacctgatgggaggtgattgggtcatgggggtggtttccccatgcggttctcatgacagtaaaagagttctcatgagatctgatggtttcaaagtgtagcacttcctacttcacactctgtctcctcctgccatgtaagatgtgccttgcttccccttctaccatgattgtaagtttcctgaggttttcccagccatgcagaatggtgagtcaattaaaccttccttttttttttttataaattactcagtatcaggtagtaatatgaaaatggactaatacaaatggtgtccttataagaacattagattaggacacagccacacacagaagaaagaccaaggaaaagacagccatctgcaagccaaggagggagggctcagaagaaacctgctcttgttctcagacatctagcctccagaatggttagagaataaatgactgttttttaaaccacacagtctctggtactttgttatagcagccccagcaaactaatacaatgtatatagtgtgtgtgtgtgtgtgtgtgtgtgtctgtgtgtgtgtgtacatatatatattatatatttgagagtatattatacatgcatttaattatgttatctctgttgttggtcactaaccctaaagagagggccaaagattcttaacctcatgcccaagtagcttgggactcctgatacaaggcagggcaactctggatggtttttttgttttgttttgttttgtttggagatcattcttgtattgactattcttaagcccagatcattatttgtctaatttgaacattctgataagcccatgtgattagaactgctggtgggagtggaagagtgctgcatagaggcatagaggtctaattcagttctttcaagttgaatcttgactcaggtgttttcttccacttgtgaaatgcagaatttgcagaacagtgatcactagtgagaacatcagtaagagctgctacctagcacaaaagacaaggtggaaactgttgagaaggtcaagtaagtaacacacatatctttataagttggggcattataatttcactttcatataagagaaaaatgggttcataaatcctacaaatgtttttctgacatatagaaagttatagtaatggagaaatccaaaacgaaatctatgttggaaaatagagcattagctagcggataatgtgataaggagggaaaatagtaaattgagaaaagattagaattagaagagggaatattgccaacaaccacgaatcacactttaacagcatgaatcagcaaccttgctaaattctctaattaggtctaatagttgagaccaggcgcggtggctcacacctgtaaccccagcactttgggaggccgaggtgggcagatgacctgaggtcaggagtttgagaccagcctggccaacatggtgaaaccccgtttctacttaaaatacaaaaattagccaggtgtggtggcaggtgcctgtaatcccagctactcgggaggctgaggcaggagaattgtttgaacccgggaggggttggttgcagtgagccaagatcgcaccattgcactctagcctgggggacagagcgagactttgtctaaaaaaagaaaaaaaaagttgttggtggaattttttgtttgcactttcttggtagacaattgttaacatagaagcacaggttggtgcctttctctttgaaatcttaaactttttgtttattattattatcatttttaatctcattgctctggctaagaattctggagcaacgttggaaaaaaaaaatagtgacagtggacaatttaccctgtccttgattgtaatatctctaaaattttaccaaaaattgtttccgtatatgattttcctatcagattttgcattatgaggtcacaatttttggtgtcttttttgttttcataatttccctctgtagaataaccttggtcaacttattcattcttctacctgatttggttgcctgagccaacatttgaacttcttatagaagttttatttttttacttttggcaaaatgtttcttgatgccttctggaaagtcctgcattgtaacatttgatgacactgatttgcttttttacatttaagatacttagcaatgtgccccatgtgcttaatgtttgtagtcccggcatcttgaaaagtcccaaaatacaatacactgcctacctttacttgctgagcgaaagtaaaaaggaattcatgcacagccttgagcatgaggaaagagtgtaatacttgggaaaattaggtacataggtaacacagtttcaactttttggtgaggaggactttgaaacttgaccttgtatgttcttttacgtttcttttgcatttagacttgaaaaatagaattctggatttgtcagagtaggcagaggaaaaacaagcccaatgaattctccagtaatccctaatccttcttacactgttttctacaaaactgttttaaaaacactgcactcttcaaattacagtcacctcctgaccctagtaagaatcacagatgaggtaatctgctacagaggaatagacttcttgcaagagtgattgctcaggagactgacttgtaggggagttggtttccagtgctttgccctgcaaagatttgtttaaaggccacattgggcaggaatacttgtgaggcctatgagtacatcactaaaatatgaccagtgccagagcatatcaacagtattttgaaaataggtttcactgaatggggtcagacaacttgataacgaaactattgtttgtgagcaaagggtattgtatttatggcatccaaactcatagtgagttaatgtatgggaagaggttgtaatgctatcctttatcttagtagaaatattattgggaagctcaaccccatgtgtggatgcagtttttaataccaattctgtataatttggggaatgactttttcagattccaccaatatgaaatatgagcctcctgccttgaaatattatgtgccaatatagtaaacactatatgggttaccaagatgatttagaagtacaaagtcatgtttctcttacataaccatggaaattaaattttcctttgagcaaaccaaattttttatcaaatttgtcaaaactcatagacctgtaccccccaaattaactttaatgcatgtacgtataccccaacagaaaaaaatacagatttaaatatatctgagaaaatgtcaatattgacaatgcattaataaaattatagcttatatatgtaggtacttcttaaattttattacatttttctctatcctcaatgtagaacacaattcctaactcccatcttgggactcaaaaactgatgccccaaaatatggtgtcttgacatgctcaactgaagacaaagcctcaaggtctctctgacctcttcgctgccaccatctcttccaaagaagttgaagttcctttatctgcccaagatccgacccagcaaggagagcaattttttttttcttcccactcctgtaagaccaagaatgtaaccacacctgagcagacattttcactgtcaaagagaactatttacaagttaattactgttcctgcatccattcattctccctagtatcccctcaatagaactcctcttctcccctctcccacagcctgtttagcaaggatgatatataagttcccgaaccccactggggtgttgggtcttcattctgaaagcttccatgtataatcattaaataattgtgtgagcctttctcctactaatctacctcatgtcagtgatttttcagcgacccttcagaaggcaaaagggaagattcctcttggtttctctacattcctattggccaaattcaattaccactaccaggatagtgactctttgtactaaatttaataggattcttccccactccctgtatctgtcagagttctccagacaaatagaatcaagaggagatacatacatatatattatacatattatatatatatgcaatttatatttattatgaggaactcgcgtacatgattatggaggctgagatgtcccatgatctgctatttgcaacctgtaggcccaggaaagctggtggtgtaattcaatcagagtgatggcataaattccagtccgaggaatttccctaaaaataatgtttgatcattaactacacctagaaaaaaatgtttaatctgggcatccccagaatcatcacgattccccaattcatgtccacctggagcctcagaaagtgaccttatttggaaataaggtctgtgcagatataagtgaggaagttaggataaggtcctactggatgatggtgtccttctaagaaaaggagacaacacacaaacacaggcaaggatgcagacaaaggccatgtgaaagtgaagcaaggctgaagtgatgcagatggaagcccaggagcaccagggattgtatggagccattgaagctggggaaggggcaagaacagattcttcgctaaagccttcagagagagcaaggccctgccagtaacttgatttcagacttctaggccccacaactgtgggagacaaaatttttgtttttttaaatgaccagtttatagtaattatgtgttatggttgccttaggaaactattacaattcccttcttgcccaaaggaactgggggacagtagcaacttgctgtgtcccctgttggaagtgtttccgttttggggaccaggactcctgaacctgcagaacccagcattacaaggacagaaggcacaaattcaaaacacaaaacaacgacaataacaacaaaaacccaaaacagcaaaaaagctgatgtttttcacctttgactcctgaacacgtgtattcttccccagggcaaagcaatgtatctaaagtcctttaactcaaaatctatactgggtcctgggagaagatcatccatccttggggcataccagctctgagcaggcactgcgaactgtgcctttgcccagactaccatcaactctctgaccatccacttctgggtggtggagaacatgataaaactagctgatgtgggcctattcttgtgcttcttttctgtaaaaaggatcctctggtcataccttaggttatgtgagatccccagttgccagagaggttctggctgaggcaagtacatggaagaaatgaagtatttgtattaaagtattattttgcctcaataataatttaataaaataatgacctgacttttacaaaatgtttttccacacatatgagaatgacaaatataaaatatatgctgtctttagctgtcttattatattgtgcctgtctttactagactctcctctttctggtcccctgttagaactattatttcttcattacagtaatcatcattcaggagttttatgtgatgataatgggttcagtacatgctagtctatgcctctgatctaaaatttgcctgaattcaattcagtcaacatttattaactaacaacataacaacggtgttgggaagggagtgtccatttcaaagttgttccacttaagaaaatgaaacaagttatactatttatctttttctgtataaccagtggtcacaatattttatgacttaagacaacaataatcatgtattagtctgtcctagtttctgcaggtgagggtttaaacaggatatagtgagaacagcccatctgctccagttttggagcctcagtggacgatgtggaggcagggtggcaggggattcgaggcttattcacccgtggggtgggggttgacactggctattggctgaagccttggctggcactgtcagctgggccacctcactgtggtctccccatgtgcactgggcttcctcataccacagtggctgcttctctgacagaaggagagcaagagcacacaagccaaacaggaagaaactgtgttctgtaagtgacctggtttcagaaggtaggtggcttcattttgatgtactccagtcatcttgggagtcagaagtaccgagcagtttcagcaggaaaacacatagactttgttatggtttgactgtgtcctcatccaaatctcaccttgaattgtagttcttataatccccacatgtcatgggagggacccagtgggaggtaattgaatcgtggaggtggttacctccatgctgttctcatgatagtgagaaagttctcaggatatctgacggttttataaggggctctccccgctctttgctctgcacttcttgcttccaccatctgaagaaggatgtgtttgtttctccttctaccatgactgtaagtttcctgaggcctccccagccctgcagaactgtgagtcaactaaacctctttcctttatacattaaccagtcttgggtatttcttcatagcagtatgaaaatggactgacatagacttcctgttctgtgagatgagtgtcaatttcactgtaaggacagatgtgagatgggataatgtattagcgtagccatcattgaaaatggccacaggaatgaatgaacccacattcaatatacatttgctctgtgtctgacactgcgctgagtgttgtaagcatatttcttattgaatctttatagtacctctatgagacaagtactaagagaccttttctcatctgcatgatgtcacatgtaaatacttgacttatataaaaatatctgaggttgccaaatagtttgcattccaagcctcctacccaaggctaatagtgaggggagctataggagtcttgccctttttaaaatttctgttcacaacataagaaaggcaagacacaaacatggcaagtacatctctgattaattcttactttttatttcagacttatttttattagattcaatataagtgtatgtggtgagggtttataattaattttgaaaagggagatgagttgaattaaaaattacatttttgtcagagatgccattaagtggaagactttttttatgactctgactaaaatgttagtttttagtatcacaagattatgatagcatgttttatctaaaaaaagctagacatcatttgggtagactcccttgtttagtatctgaagcataaagaagagaaattatttgtccgaggtcataagaggtaggatgagacctcagactcaaaggtatgctttacttctaatttattttcaattaaatattttttagataaatgaagtattctgtaaggatattatgtggatattgaccacctcctattatttgctagattcactattaaataacagaggaaacttgttgaataacattatctgccttcagtaaaaaaaatttagaaattaaaatgttgtgatagaagcagaatgctatgggaaaataattattttcatataatgatattgaaatgatttcatataattcatataatgattttcataataatgaaatgcagttaatattatagatttcagtatgtaactcaacagagtatttaaaaaccagagtaacactggatcctctgttagtacacggtttaaatctttggaaaaaaactttttttaatgtatgtgcagatatttctgaattttgggagcagcttcatcagaaccagtttatcttgactattaagcagcaattgagtagaaaatttctccatatcagaaatgttttatctttgcaaacatattgttttcccaaagacacagaaaacacttatggccatttttattgcttgtagtgaaaaaaaaaggaaaataagtaaacaccacaattctgaaaaacaagcagtatataaaacaatcaagtacatatatacttcacacatgagaaaaattatggataaccatgggatatttttgaaaactttataaaatagcagtcttataagactgacatattatttatttaaaaaattcaaaattaacattagccatagaaatactttctctcttaaacctacacagatttctctgatataaaacataaagcaggcaggagatagattttttttcgtatttcttgcacatgatctgttagaattcagtttattttattttaattgaactatgaagaaaatactggttttaaaaatttgaatagattaccaggaaatgctaatattcatttatgaatattaatgtgtcggcatgcatgaaagtctcattaatcagacaactggcacatggttgaaatgtgtagattgctactgtgtgtatccctgatgttatatgatcaaaaaagttgaaaactcacaacttgagctcatgtataattacccaaacttcttgagttttgttatggactgaaatatgcccccctaaaattcatattgaaaatcaaagccccccccgaggctgctagacgtaggcgttaggcatgtcccacccacccgccgcctcccaccgcacctcggggacaccagagctgccgacttggagattcctggtctgtgaagagtcggtggtgccagcaggaaccgggctgggcctcgtgcgtccgtggggtctgcgcttggtctttctgtgcttggatttgcatatttattgcattgctggtagagacccccaggcctgtccaccctgctaagactcctcaggcagcgtttgggtcccgcactctgtccacatttccccgatgtcccctgcgggcgcgggcagccacccaggcctgcttgctgcggccccctctcggccaggcattggctcagccccctgagtgggaggtcatgggccagtccccgaggagttgggcccctgcacagtgcctggccacacccatgatgcagggctggcctccaaccctgcggaccgcgccaggcaccaactccgtgtttggtgtctgtctgtgtttgttttcaagaaatgattcaaattgctgcttggattttgaaatttactgtaactgtcagtgtacacatctggaccccgtttcatttttacaccaatatggtaaaaatgctgctctcagcctcccacaattaaaccgcatgtgatctcaaaaaaaaaaaaaagaaaaagaaaagaaaagaaagaaaatctaagtcccaatccccaatgtaatggtatttggagaaaggacctttaggaaggtaatcaaagttaaatgagataataagggtggggctctgatctaatgggattggtgtctgtataagaggaggaccagactctggggagtgctctgtttctctgcttctctctctctctctctgcctctatctcatgtggacagaagaaaagtcatgtgagtacacagtgagaaggttaccatctgcaagccagaaagagaacccttaccagaaactgaccttgctgaaccttgaccttggatttctagtgtccagaagtgtgagaaaataacagtctgttgtttatgccactaagcttgtggtattttgtcatagcagggtaagtagactaatacaggttttctcttcagttattcagaataactgggaaattggaaaataaattctcattttcaggaaaaatacatctttttttacaagtgtgattttctcatagttagaattcatgaattgcattcatatattatataacagtaactagaagaatatgaactggtgtttaaagggaaaaataagttaaagtaaatggtgcacagaaataggattcttcagcacaacattggaaagaggagactaagctaaaaacatcaatgagggtgatgtcagcaagatggcagaataagaagtctcaactctctttcccacatggaaacaccaatttaacaatgatatatggaccaaatatcatcagtctatgtacctttatgagagggtcagaatccagttgagaaactgcaggcttctagataagcacagagctgagaatggctatattgaaccaggtaagagcaattttactttactagtgtcagctctttctccaagccagcatagctcagcaccaagagaaatgggctcagcctacaacttctccctcatggatgcagagagaatggactgtgcttacaacaaccctggctttttagttcactgcctaaagaaacagattctgtcttgcctcacatggagttctgagagaactggcatacttcagatgtccagagatggtcaaggacagagaaaaagcggtgggggcttactgctgctggcatggctctgtgagatagggagaaggagcttcttcacagagaatgatggatagaaatgtagtatgcctccaatgttccagcctgtggtacaggggtcagataccagaaggagtaagagattgaagcctcctggaaagaaaagaaaaaaggaaaggaaagaaaaaagaaagaaggaaagaaagaaagaaagaaagaaagaaagaaagaaagaaagaaagaaactagtaaatctgtctacttacctatgcattcgttcagaaaatacacatccatggaagggtttgagaagctcccagaatctctcccaaggctgactgatgaaggtctccctctgtctgagtcagtctataaggactggaaaaagcagctatttctgcaaatgcacaaacaccaacacaaagctacaaggaccatgaagaatcaggaaacaacgatacagccaaagcagcagaacaaacctccattaaatgaccctaaagaaattgagatctattaattggctgacaaataatttaatacaattatcttgaagctcaatgaattataagaaaacagacaactaaacaaaatcagaaaaataatacatgaataagatagaaatattaacaagggggtagaagctatcaaaaagaaccacgcagaaattctggagctcaagaatataataacaaaaccaaaaactttaatacagagcttcagcagcagattttatcaagcagaagaaagaatcagtgaactcagagagtgatcatttgatattgtttagtcaaaggagcaaaaagaaaaaagaatgaaaaagagtgaacacttaagggaattattagacctaatgaagtttttattgttcaaatttttattttaatgcattataaaagtttcagaaaggagaaagagggaaaaaatcttatttaaagaactaatggcaaaaaacttcccaagtttgggaagaaaaacggacatccagattgctgaagctcaaaaggccccaaaagtatgaacacaaagaaatatacaccaagacacattataatcatattgttaaaagtcaaaaacagtgggagaattttgaaagatgcaagagagcaataacttggcatgaacaaaggggccccaaagactactaggagatttctcagcagaaaccttgtaggcaagaagaaagtgtaaccatatattcaaagtgatgaaaaaatttgtcaacaaaaaatactatacctggcaaaattctttttcaaaagtgaagagaaaataaagacttccagaaaaaaacagaagttgaagaagttcattactactagacctgccttacaggaaatgctaaagggagttcaagttgaaacaaaaaggacaaatatgaaagcatatgaatgtataaaactccctggtaaaggtaaacatgtagacaaacacagactactgtaatacttcaatagtgatgtgtaaatacttttggttttaatataaaatttaaaagaaaaaagtagtagaattactacaactacaataatttacaacatgaaaagctgtaaattgtcacatcaataacaaagtgtattggaggaagaattaaatgtgtagcatttttgtatgcaattgaagttaacagcataaatgtaagcctaatggtaatcacaaagaaaatacctatggaagatacactaaaggaaaagagaaaggaatcaaaatatagcctgaaaattcttcaaatcactaaggaagatagcaagagaggaaaagaggagcaaaagtactccaagacagacaaaaaagaattaacaaaatgacaataagtacttgcttatcaatgattaccttaaacataaatagattaaatttatcaaaatcaaaatacatagagtggataattttttaaaaaacaaaccattttcaactatatgcagtctataagagacttattttaaatttaaaaaatatatagaatggaagtgaaggggtggaaaaggatattgcatgctaatgacaaaagaaagcaggggtcatgtatttggccattcttgcattgccataaagaaataactgagactgggtaatttatgaaaagaaaagagatttaattggctcatagttcttcatgctgtacaggaagcatcctggaatatgcttctggggagaactcagaaagctttcagtcatggtggaaggcaaagtggaaacaggcatatcacataagaaagcaggagtgagagagagagagagtgggggtttggcgatgtcacacacttttatgtgaccagatcttatgtgtactcggagcaagagctcactgatcactaagaggatggcccaagctgtttatgagggatctactcccatgatccaaacaactcccaccaggtccctcctccaacatcgaggattacatttcagcatgagatttggacaggggcaaatatccaaactataccaggaggctatacttatatataatggactttaaataaaaaaccgtctcaagagacaaagaaagttgttatataatgataaaagtgtcctgttgtcaggaagatataacaattataaatatatataatatatatatatacatatacatatatccaatattgagcatatgtatatatagcaaacattgataagtctaaaggaaaaaaatgaatggcaatataatatttgtaggataatttaatatcctattttcagaaataaggaaacagtggagttgaacagatccgtagacaaaatggatctgatatatattgtattggtttgtttgggctgctctaataaaatatcatagattgcatagtttataaactatagacatttatttcccagcctccttctggaggataagaagtcccccatcaaggcactggtagattcagtgtttggcaagcgcggatttcctggtttatagaaggcagcatttcactgtgtcctcccatgacagaaggggcgaaagtctctctggggtctccttcataagggtactaatctcattcatgaggacttcacccttatgacataatctctttccaaagaccccacctcctaatcattttgggggctagaattttagtgtgtaaatttgggggttaccaacagtcagaccatagcaagacatataagaaacattctacttcacatccgcagaacatatacttctcaagagcacttagagcattctccaggatatatcacaggctggttcacaaaggaaatcttaacacatttaggaagatttaaatcatgccaagtatgtttcctgactaccataaaataaaaccaaaaatcagtaagagaaggaaaatgaaaaaaaaaacccacaaatatgtggaaaacgaacaatatactcttgaacaatgagaaataaaaatgaaatcttaaggcctccagctgactgaatggacctcctcttggcctaggggaccctagcaaaaccttgaaaacagactttgtggccatgacagtatgggaggtcattatacccccttcctcactaaccacctttaccctttcttccctaagggttaacctgaaaccagccctttggaaaggctcactacactactatatcaaccagctgcctgattctgcccctcccatttgtgatttcaataaactgtccagtattccttcccaataagagaccactggccacagagtggttctgccagtctatgggggatgtgcagtgagggtttcatgtcctctgctttaccttttgatgtcaaagggctgaaaactccatcccagaatcatgctaatgccaccattttttgaacatgggtcccatggtgaagcatgaagctcggctgaacatctgcattgttctcctatcataaatactcatgacttctcctatagcttattgaatatggatatttggccaccacattcagcataaatccctgtcttattctttctaccctgaaagggtctgtttctggcttctgggtggagattacctttcctagcctgtcagaatggccaccttgcaggctgcaatcatttttgagaaataaagctctcctctccaagtttttgaacctcatcattcctcagtggacacaacctatgggtcagagaagaaataagcagggaaattagaaggaatctcaagacaaaaacaaaaacaaaacacaatatgccaaaacttaggtgatgcagcaaaaatagtactgagaagtttgtagtaatgaatgcctacattaacaaagaagaaagatctcaaataaatgatctaaatttatgcctcacagaattagaaaaagagcaaattaaacacaaagttagcagagggtaaaaataaccaatattagaacagaaataaagcagattaaaaatcaataaaaaaactgcagttaggagttgactttttgaaaagatatgaaaattcgacaaaccttcatctagactaagaaaaaggagagaagagtcaaacaaataaaatcagaagaggagacattataactaatgcaacagaaattaagatcataagagatttctatttaagaaagtgtatgctaacacattggaaatcctggaagaaattaatgatttcctagaaacatacaacctaccagactgaatcatgaagaattacaaaatcttaaacaccatgtcttggtcaatttgggctgctataaaaagggccttagactgggtaatttacaagcaaaataaaggtaccgctcacagatctggaagctgggaagttcaaggtgcaagcattattggtgtccggtgagggttagctctcagcctcatagatggcaccttcttgttgcatcctcacacagtgaaaggggcaaacaggctcccataggcctctttaatatgaatactaattcaccattcataagggtgaagcccttgtgatctaatcacttcctaaagcaccacttttaataaaattgcattagggattaggttgcaacaaatgaattccaggggagccaaacattcagaccatggcagagcaataatgaataatgagattgagcctgtaatcaaaatcttccaacaaagaaaagctcaagactgtatgcctccataggttaatgctgctgaacactcaagaaagaatgaacaccaatcttccttaacttatttcaaaaaatctaagaagaggaaagatttccaaactcattttatgaggctagcagcaccctgatactaaagccagataaagtcactacaggaaaagaaaactaaaggatgataaccctgataaacatagttgcaaacaccctcaacaaaatactatcaaactgagttcatcagcatagttaaaagggtcatacaccatgaccaagaggtatttatccccgggctttaagggtggttcaatatatgcaaattgattaatgtggcacactgtaacagaataatgtaatgcaacaaaatgaaggataaaaatcatctgatcatctgattatctccatagactgcagaaaagcatttgataaaattcaatatcctccttgataaaaactctcaacaaactaagtatacaattaacgttaacataataaagccccaatgtgaaacacctaccaccagtataatacaatattcaatgtaaaaaactgaaatcatttcttctaagatcagaaagaaggcaaagatggctattttagtcacctgtatgcaagatagtattggcagtcttagccagtgtaattgctaagaaaaagaaatggcatccaaatagaaaaggaagaagtaaaatgatttatgtgtgcatatgacatgatcttatatgtggaaaaccctgaggacgaaacacacacacacacacacacacatcccacacacagacacacacacacacacacgcacaaactgttagaactaacaaatgaattcagtaacatttcaggattacaaactcaacataaaagccatgttactattaatgactatctgaaaaggaaacttagaaaacaatcatatttagaatgacatgaaagatactcagaaataaatcagggaggtgaaagactttgccttggtccgttcaggcttttataacaaaatgccttagactgagtaatttataaacaacataaacttattgctcacagttgtggagtttgggaagcccaacatcaaagcagcagcagattcgttgtctggtaaggacctctttctcagagatggtatcttcttgctgcatcctcacatggcagaaatggcaaaaagtccctctcactcctcttttgtaaaggcactaatcccattcatgagggcagagcccctatgacctaattacctctcaactgtcccacctcttaatttcatcacattagggattagactttaacacataaagtttggaggaacacaaatattcgaaccatacataacaggcttgtacactgaaaactgtaatgcatagatgaaagaaattaaagaagatacagaagacagaaataaatacaaagacgtgtgatcatggactggaagacttaatattgttaaaatgttcatactgtctaaagcaatctacaaattcagtgcaatcactatcaatatcccaatggcattttgcacagaaatagaaaaaaaaatctatcctgaaatttacatgaaaataacaaactaaaaaccccaattaggcaaagcgatcttgagaaagaaggacaaaactggaggcatcacacttactgatttcaaaatatatttaaaaacaaaacaatgtggtgtgagcattagaaacagacaaatataccagtggaagaaagtcacaatcccagaaataaacccacatataatgtcaaccgatcttcaacaacgatgccagaaatatacaatggggaaaggatagtctcttcaattaatggtgctgggaaaactgtacatccacagccaaaataatgacactggatccttgttttacatcatacacaaaaatcaacccaaaatagattaaaaatttaaatgtaatacctaaaattgtaagacttttagataaaagcataaaggaagagctccttgagattggtctttgcaatgatttcttggctatgacaccaaaaacacagtacaaaagcaaaaataggtaagtggcattttatcaaagtaaaaaagttactgcaaagcaatggaaacaataaacagagtgaaaaggcagcctatggagtgagaggaaatattagaaaaccatatatctgataaggggttgataccaaaaatatgtaaggaaatcctacaactcaagagcaaaaaaacaaatatctagattaataaatgagcaaaatacttgaatagacatttctccaaagaaggcataaaaatggtcaacaagtagataaaaagatgctcaacatcacaaaccatcaatgcaattcaaaagtgaaaaatacaatgagctatcacttcagacttgttaggatggccattatcaaaaaatgacagatcacaggggttgccaaggatgtggagaaatgggaagccttctataccgctggtaggaatataaaatggttcagctactattgagaaaagtattgaagttcctcggcatattaaaaatagaactaccgtatgattcagcagtgtcacttctgggtatatatatgaaagaaatgaaatcaggatctagaagagatatctgcactcccatggtcactgcagcattattcacaataggtaagacatggaaaccacctgagtgtttacttacagatcaatggataaagaaaatgtggtgtgtacatacaatggaatattatttagccttaacagagaaggaaatcctgacatttgcaacagcatggatgaacctggaggacattatgttaagggaaacaagccagttacagaaggacaaatgctacgtgattccaatgatatgagctacctaaaatagttaaactcacagaaacagagtagattcatggtagtaggggttacacggagggagaaatgggaagtgttagtcaatgaatctaaagttatataagatgaataagttctagaaatttgctgtacagcactgtacctgtaggtaagaatactgtatagtactgttaaaattttctttacaaaaaggaaaacaatcaggtaaagagcctatagtcattgtaaaataaaaatcagtctcttggttttgcatttttaactagcaggtaacacaatgaagagatttttaaaagaagcttataatttaaaaacctgcctattgttgctggaaattcacattgaatggcattgtcatatatgttatttataggtctgcttcactcctattaacatgttagctcaccttactaacttgcctcacccatgatcaattaaattttcagtctccaggtaaatcttgttctcagcagacaacatactctcagtgaggctcagcaaccaatgatggataagctctgactcagatgtgttctcctccctcaagctttgctgcaccaagcctgcccacagctaaaggaatctgatgttactctagttcactctacacagtcacttagcaggctggtcattctcagcccactgaagcatgtgagtggaaaggggttgtgagcagcctaaagaaaacagtggcattattgttgcttaataacagaaacacataaaagagaatgaggaaaacttcaatgtcacaaagttattttcattagaataagcaatatatggaatttagagttgggatactatttaggtgataaaagtaggaatggtgctttcaacttcatatatttttaaaatatcacaggctattaataccaggtctatatgcctcttttatgtgtaaaagacataaatacatttgttgttaaaatataagaatctacttacatataatttctattgaatgattttttcctactctttttgtttcataaaaaaaccgtcacctttttatcatacacacacacacacacacacacacacttttcatgatataggcacacacaaacatttcttgtagccaatatgtgctaacagagtcatcaaatgatccctaggtatatactcaagagaaatgaaaaccacatgaaaacaaaatgttcatagcagcattatcattattcatagccaaaaagtagaaacaacccaaacatccatcaactaatgaacagataaacaaatgcagtatagtcatgcactaaataatgacttttaggttaaggagactgcatatacaaaagtggttccataagattataacggagctgaaaaattcctactgcctagtgacatcgtagctgtcataaagtcgtagcacagttattttaaaaatggaatgtagcataagtgtgcagtgttcattaaatcttcactagtgtacagtgatgtcctagaccttcatattcactcaccactcactcactgactcattcagaggagcttccagtcctgcaagctctgttcatagtaagtgtcctatgtaagtataccatttttcatctttcgtttctcttttctttttgtttgttttcatttctttttgtttctttctgtttgtatgttttttgacagagtcttgctctgtcgcccaggctagagtgcagtggcatgatctcggctcactgcaacctccgcctcccaggctcaagggattctcatgcctcagcgtcccgagtaactggatttacaggcgtgcaccaccatacccggctaatttttgtatttttagtagagacagggtttcgccatggtggcctggctggttttgaactcctgatctcaggtgatctgcccgcctcggcttccttaaagtcctgggattacaagcataagccaccgtgcccggcccttatctttcatattgtatttttacggtacctttcatgtgtttagatacataaatacttaccattgtgttgcagttgcacacagtatattccctacagtaacaacacgctgtacagatctgtagcctaggagcagcaataaggctaagccatatagcttaggtgtgtaataggccacaccatctaggtttgggtatgtacactctatgatgtttgcacaacgatgaaatctaatgatgcatttctcagaatgcatcctcctcatcaagtgatgcatgaccgtatcctcccgatggaatattattcagcaataaaaaggaatgaagtacagatacatgctgcaacatgaaaatgaaagtgttatgcgaaggaagccagatacaaaagaaaaaagtattgtatggtcccatttatatgaaatggggagaacaggcaaatttataaagatagagagtagattgttggttgcctatggcagggagttggaggtatggagggcaatgggtaggactgcaaaaagttatgggggcttgtagggggtactgataaaaatactttaggtttaggttgtggtcgacggttgcaacaatatatgaatatgctgaaaaccatcgaattgtgtgcttgaaatgggtaaacttatggttagtgaattatatctcaataaagctgtttaacaaaatagaaaacaccaggattgcaaaaggacatttcatcaggcctgtattaaagcaggattggtaactgctatgatttgtttgtcccctcggaaactcatgttgaagtgtgatctccaatctggtgatgtctggaggtgggatagtgggaagtgtttggttcatgggggtggatttctcatgaatagattaatgctttcccacaagagtgagtgagttctctttctggctggactgaattagttgctgaagaaatgagttgttataaaagtgagtccagcttcctagactctgtcttgcttcctctcttgccatgtgatctctttgcacatgaccacttgcttttctgcttctttgccatgttttgactcagcacacagctcttaccagaagccaaccagatgccacgctatgctcttgaacttcccagtatgcagaactgtgagctaaataaaccacttttctttatatattacccagtctcaggtattctcttatagcaacacaaaacaaatacagtatctatggcctagataccagtgacttccttaaatttccccttcccttccgtatatctgtatttcccaatgagcatcttcttcacagtgaacattaacaaaatacaagtccagactctttcatgtgaaaccttgatctgtgctggagctgcttccccacaggcaactccatctcctacatgagaggcaggtgaaacttttaataggggtccctgagaagtaaaatgaaaaatggtacataaaaagcttttgacaaaattggagataattatggctttatgtctactattccaattacagagtggcaaacctgcattttaaaattgttcctttatatattatttcactatgaccaatgattctcctggacaatggaagatcaaatgcatgatttataattaaaacgtttctgttcttatgccaggagatgtatatattgaaattcaaaagtattgcagcacacttacagtgattcaatattacaggtaaaatatatttcatgtttcacttatgacaggtgctaattaaagcaagttacatgcattagttcaaagaaaattttttttcatttttttcattggctggagcataatcagaaattatcctatgcctttgttgacatttaagaaggtgtcttagagattttaatacaaatacaaagtgtttgcaactgggaagtaactttagaaattatccatttcggtgttttcatttaaaaatgaggaaaccgagagaggtgaaagccctaaggtcgttagaactaagtggtaaaaagaatataaatgccagtgttcccagtcccatcccatcaggatactttctttcaaaactcacataaactaaaataaacatgtctacaaagagacgacacgatattctagttctgtattagcctcttaatacttgtgggtgacgaacttactcaaactgaatctaaccttcctgatttttacaatatctcacctaaattctatgaattttgtgatgctcagattaaattacacagacaacatgtgcttcgcaataggtataccaagaattaccattaaatctactattgcccacgttgaaatctgggatctagcaaaaaatcagctgtatgataacaggcaactttcttaaaaaaaaaaaatcccttgccatccctcagtttcttcattttttcacctaaggatagcaactgtatctacctgacagcattgttccatgaggattaaaatgacagtgggttttgaaaagtgctttggaaagcatttcatactaagggccctttaagttgtttgaaaagttatcaatatcatcatcatcaatcattatcatgataatcattattataatcaaggaattatttaccaggtgctaatgtgtttattggcctatatgtcttttccacataaatgattcagaaataagaatttcaagatggtcagaactttgtgaaatctgaaagatcataatttatattcaaatatttggatgtaaccttgatatacaatgaaaattaggtcagctcacatttagtaatttaaaaaatcactgtgtgagaggaatgttttaaatatgcttttgggaaagatgaaaaaattcaatcagtaaagtaaaactgttgaatttcagtattgtttttattagtataattaccacaaaaaacaacataatcaaaaggaacacttggaacaaattgtaaatgagttagtattgtacattttctctcaattccagagcaaatatgattactaaaagcaaaggatatttttgacacatactcttgttgttaacatggacactaaaccaaggtttatgtaacaattacagtttttaaatgaaattaatttcagcttttattcagtttcagttccaatatacattggtaaaagtagtcatcgtgactgaaaatgagtaataagtgacacagtatctttcataaaagatttttacaatctttaaaaccagtgagcaacaaatgataaaaatttatattatctctactggataattatcaagccataagtttattttaataaataaatataaacatgacaattataagtgcatatttaaagttaacttgctagtaaaaattcagtagtattccaaagtcattatatgccagatttatttggcagaaatgtgtctgactccagcttaccttttatatctcatcaggaaatatgcacctgagagtcatttttcccttacaggagcctcctgtgatgactgaagaagccctagcccttttgaaattggtgatgtagagcttcatcatttcctgtttaaaccaagaaaattgtgtgagttgcaaaactctaaataatggatcaccagtgagaataatatcatttgccagtgacataaagttgataagaaaatgtgctggcaaagtggggtggtaggaatggcaattggtttagacatctttcctgtgttgtcttttggcccatctatcccagtttcttaattttacagattaagaaaaataaaaaatagagaagcaggaaaggaagatatttgctcagagactctcaggtagttaatgaaaggactttggcgtcctgtataggttcaagaacctgtagggttctttctgctaccccatcttaagatcacacaagatgtatgattagaataaattttggaaaagtacacagctgtaaagccactagccattttatttcctaataggagaaagattggagcttagggaattagtgtgatatgtataacataaaatgtaaggaatcagagtaaaggaaaccttttttagtagcacatgccatggtgcatataaccaagaaataaacatctacattgattaacatggaaataagtaaaattggattgctaaaccaagtaatttaattttaaaattgtaggattttcacattgctaaaatgttaaaagtattttgaaaagggaatcattcgttacttataccctaaattctttcaaagagaagtaaagcaaaatgagagatacctgaatttatatagaagcataaactataagaataaagaatgctgtgatttggagcttagacgccgtaacactaaatgtaatgccacattgttaaaagtaccctgggtccagaccagtcagatgcaaatcttgaccttaccacttgcttgcagtgtgaacttgtacaaacttaagctacgcttgcctcaaagaatggggataataatgaatctacatacatacacacatagatcagaaaagtgcttatagcaatgctgaaagtataccttgtgttagtctgctagcactgccataccaaaataccacagtctgggtggcttaagcaaaagacatttatttcccacagctctggaggctgaaagttcaatatgaagatgttggtaagttcggtttctcttgaggccactctccttggcttgcagacagccacattctccctgtgtcctcacatggcctttcctctttctgcatgcatcctgggtgtctcttcttcttcttataaagacgcaatcacattggattacagtcccaccctaatgccctcatcctaacctaatgtccctcaggaacattatctctaaagatggccacattctgacatactaggggttgggatctcaacacataaatttgggggaacataattcggcccatcacatacatcttggatcttctaccttgtggaacataactggcggaaaggccaagctgcatctgaaatgtacaatgcacttattctgaggctacacttcccacaggccagtggctgagcatcacaggatcactcaggaaggcccctttgtataagcttaagaactccctctggctttgcaggaattttctttaaaatgcactgcactctttctccttctttctctgtttccttccttcctccctcccttccttccttccttccttccttcgttccttccttctctctttccttcctttcttttttccctccttccttccttcgttccttcatggttccactctccatggaatttgaacatgctttaattaccataaatctatttttaagatgtgttgaagcatttttgctgaagaactatcagtaattacagttgctaaaaagcagcttgattttgttttcagcctggcgcatatctacttttatgtcaagtgaccaaggcgtgtactttacaagaacaattttataaaagaattctgtaaggtgtcatcatttactgaaaaactacatgacttttagcacctacattcttctggaaaggttgattggttcagcagaagtcttgaaaagtggtaagaattcatctaaagtgttcacaggtacctagaagctttggttcctggccctgtgttatgttgataggtggtacatgccatgaacacatgccagactcagtagtctttgtaaagtttcttcaccaatgttgatggagatagtgaacagtttgtatcatgatgagtagtttcatagagaaatttatggaatacctatttgaattcatctggtgccaccatcagactatcttgggagtgtcagagattacctgagcgaagggttagaccaggtagcttcaattctttctttataaaatctcaaactaaacaattattattgtatagtggcttatttggaatccacctatagatttatcttttggtactttagataggattataaccttggtaaagactcgtttggcataatgatctactagataatttcttttaacttccatattgccccttcttgcatggacctaaaccattatcatagtcatctgtctaagaagtaggagtgcctctaaaagttccttaactatagtctattttttttggtcggtgttgtcagctacctagaaacccctttgtttccaaagcatctcctaatcatgtattactccagaagcgtgtttgttatcagtatatatccctctctgaacttcggtgaatggaaaagctctagcaagtgcagtaagttctcccatctgggctgattttctctcaggtataagattgtattctaaaggagagcttaaattagtgagagtgtatcctgtttaatcccctccagtttcagttttgaggtatgatattagatgaagttgctcaatgtaagcctctaatacatctgggtgagatagtgaaggttacctaaccatggtaaggtgatcttgaggtcctctttattatgacgaaggcaggaaagcagaaggactcagggtgttgtaggactcagtagtttaactgagacctaggtcaagcatggagcctagaactagttcagcagaaatattgacatgtaatagcaactggcctaagaccaagtgaacaagtcaaatgaggctatagtaagcatttgggttttttgtttcccatgaaccacagaggacaaaaaggcttgttcaaaccacttatgcacaaatagacaaaaaaggctgtttgcagttaacgaagcctagggaagaaagctttgaaaaaccttccttaggtaatagaaggcttgttcatgttttgaatcctaaaagagagagtctcttatttaggacttagtcagttaataaaattgacgcaatttcagaaaaaaaaaattggcacatgttgtctgcaatatccagttaaacccagaaatcctctcaattattgtattgtaagaggtttaggaacagttcagtagtgtttattctatctgaagagaggccttttttttttctccttagatagatcatggcctataatggactgtgttttggtaaaattgtaatttagcttttgaaactttatgttctttcccactaaagttgagagcaagtaaatggattccttttttatgggtttcctttttctctcaacaaaataggtcatctacatattgtgtcaaagctgaatcaaaagaaaatttagaccttctgtcttgattgaaggtctggaaaaaatatgagggtgctttagttaacttctagagcataacagtgcaggcatattttcattctccccaagtaggaccagaagatatttgttgtctgctctaggggcatgctgaaaaagagcacagatctgccacaaggacttaagtaattttaggaattgacaacaaggtgatatttggattaggtactactgggaagtgagaagtgagaagtgggggctaacaattttattgatggccttgaggttttgaacaaatacatatccttggccatttgttttgcaggtggtggtgtttttcttctttcttttccttgtagaatggaagtgttacaatgttacaaaggctagttcagagtaagagaaggcctttggatataaggcctttgccaatgggtctgagactttctcttgcttctggcttcaagggatattggtgaagattgggtaacagtttggtgaggtaaaagattaataagatctgttccaattattttcccatgttagtgtgtgtcccatagtgtgtcaggtatgatgtcaagatcgctaatggaggtatgcatcaaatgtaatggagaggacaaaggtatatcaaagtataatctacaacttgatcatgaacagagaaatcctctgaaatttcaaaacatacctggaacttctggtgtgcatttaatattatgatctcatttgaaaagtaaatctctccctgtcaaatttgcagctgtgttattagagaggctgaaagaatgtttttaagtcaaatgcccaagtgttaaaaactgggagatagtaaaaacctgtgggttattgaaatacctcctacctgtgtggtaagtttattctgaggaagaggaaggatttcacatggaacaaatagtacctgtgtccaccaggaattgatgaggttgactagttttatatatatagtcaattcaacttgattatttaagggtaagataggcatgtttttcccttgaagtacaattattaatctggatggaggaagttttttttggcttgaattttcttttgtaaaataaaaccattattattccacttttgttacaatgttaacaagcatccttgtcaatacaagatcagttttaaaatgggctattttactgtttgatctgcagggtaataattttattttgggtcttgtctcaattttgttgtaaatctctttcaatgtgttctgagttaggtgcaaaatttaggaatgtaatgagagaaaaaaaagttttcctggaaaagaagataacttagacttagctgaccccataggagctggcaatggttggtcactagtgatacttgtgtacattgtgtgtttgaccccaaatttgataattgtctgccactaaatgcagatgtgactatctgtgcttcttgataagtggaaatgagagagaatgctttctctagaacaaagccacactcttagaacaaaacaaaacaaaacaaaacaaaacatgagttgaaatggacttcattcggctttattggtgacccactgaaatgtctggatgtatgccaatctggtgagaactgcaaactcactatggtatgaagcaagctaaacaagtttatagggactatgcctaggttatattgtgtgattttgcttattatgaaaaacaacacttttagacagtacaacataacataggagcacaagaaatagtaaacatgaatgaatagcaatggctcaattccaccagggtgccgaacaaatggaaatcaaggacaacacctgggggtaccaaactaaaaatagttgaggaacccatcacaaagggacctgtaatagtccgttctcattattaatataaataactacctgagactgagtgatttataaagacaagaggtttatttgacttacagttccacaggctgtacaggaggcatggctgaggaggcctcaggaaacttacaatcatggtagaagggtgaaggggaagcaagcacatcttcacatggcagtaggacagagagagaagcaggaagtgccacacacttttaaaccacccgatctcatgagaactcactcactgtcatgagaacagaaagggggaagtccaccccaagatccaatcaccccccaccaggtccctccgccaacattagggattgcaattcaaaatgagatttgggtggggatgcagagccaaaccatatcagagtcagacttcagacctgttctgtgttaacacgttggcacagagtcaacaagtctgatatggtttggctgtgtccccacccaaatcacatcttgaactgtagctcccataactcctacatgtgggagggacctggtcaggaataaatcaatcatgggagcagtttcccccatactgttctcatggtagtgaataagtgtcatgaggtctgatgattttataagaagtttcccctttcactttgctctcattctgtcttgcctgccactatgtaagatgtgtctttcatcttgtcatgattgtgaggcctccccagccacgtggaaccatgagtccattaaacctctttttctttataaattactcagtcttgggtatgtctttatcggcagcatgaaaatggacgaatacaaagccccagcagcaaggcacaaggggcttgcttgtgtcctatgcctgtttgaaggctggggtttgcagtgatgtgcagtgtagatcatttcttcatggggcttccaggaaaactctggaaataagtgaagcccactcaagtgaggaaaaaacccagaaacttatctattcagagcttgctaaagtaagggtgtcagccaccattactggtgctagatagagattcaaaggcaggcagaggagtggggaggcttcatattgacaaaaataaaaagggaagctttcagataggctctgattggatgttgttggcatgaggaagctgaagacaggctacctagaagtgagacatctcatatgataggttttggaagcatatttggctttctctagttagtctcgagttggaagcagcggcaacaaataagaaagctgactgtctttgaccaagccatgatttttctgggcttattgtggttcaagttgttgtttgacttaccgagatggttgctgcagaggttgtgagtcccagctttattgtcatacgtggtcatgtgacctggcctttgtccatttgtatgtggagtttctccacttctattgtcattattagtgatatcatccacaggacatcatagcccccagtttgttacaaagaaagaagcaaacatcaaagcagaaacttctggagcacagagttgactcctcttaatttgattataacaccatatataaaacctctggcccaggttttgagatgattaaataccatacatatgtttggaaagtctgcctataaaatctctcaaaagtcaacactctgtgttgccctccaggagttcagcacaggggacgcagaccttacagtaatctcccttgcaagaattcccttcaaaaggaaggacatctttgccccactttgtcattccttctacacatttcacttagaagttcattttttcatggttttacatctctatatgaattttaaatcctggatggaaatatatccatgtctcttaaatttggatgcacgtcttactaacttttattcttgtgtgtcccatctgaaattgctatcttttccacactaggtttcttttcttgtatttccaattcttttgtccacaaaatgcccattcgttcagtttccaaaacttgagacaagttcctagcccttgaagcacatagtcttagcccacctttgatatcagcctcatcattcctgggtctgggtggtgccaactttacctttaaactatatttggaagctgtattttcctctttagttccactgacacttccctaatttggtttctcattaaattcagataggctgatgctctcctacactccagccattctcagtctgattcaatgaaaccattgatgtcagactaaattctttagagccatacctgaccatttcacttttctgttgaaaaacttcacttattcctttggttatataaagtaaagcctgtatatcctagcttgtggtgcaatgcactcttcatcaccatcttctcgcccttcctttccctatttataagcccataccatccttaatctgagcctctcatatgactttgcatgctcagctccacatcagaggcatccaagtccatgtccaatctttcgtattgaacagaaagctttatgagcagcatatctatatttaattcatcttatttttaataacatttagaataattaatgacatttattaaacaataaaaattaaattcttgagtcaaaacaaatatatatatgaaatatatatgaaaatcatttaaaaatgcaatgacaatggcaaaatgcaaactttgataaaaggtatgattatggcaaaaattatgtgctctagtacgatagcggtcaatttctacagtgaaaatgttgaatggagtttggatttgatgtaaatatttaatgaattataggattttttttttttacataggaataacacaaaaccccatgctaagaagaggagataatttcaggaaagtttttgatgtgcagttacaatgagcatctttatctagttagataacagggaatcttgagtatcattggaattcatccctatttctcctctcttctctccctttcttctagtgtcgaaacaggtacaagaaaaatcaatgctgtggagaatagaccataaattaagtgtcccaataatttgaacatatgatttaaatttaaatattttgtactacagttgataaaatgtagtactaaagttctaaaaaataactgtagctctgcagctatgaaaagagaataaagcaggatagaagtatgttttccctgcacttaagttcaacaaaagagtaaaagcttgtttactgtggaaagtattgtgaaaaagagatttcacattataacttcagagtttttctgattagatccacattttactttggcataagtgaaatatttatgaaagattggccccatctttctttttttcatttagtaacagcaaagtattccaaagggattcttcaactaaaccttgattaaccagaacattcttttgtaaaacaaatggaaaatcttgatattaccataaaaacaagagaatttttagccttcctacaaccctggctttctcttgtatgctgaaaaccattactctgccctctaatgattttgaacattgctggctcaggggagagatgagaagccaattggatcaatatctggagaggaagctcttgggtaaaacaaaatgcatagctgtgataaccaggattgttttatcatcttgggaattcataaccagtagaatcatgttccaggaaatgtggaaatggctatgactcacaagaacccagccagcatttactaagcttattccatgtattttatgagaatgtggtcacttttcctagaggtaagaattgtttgtaagccatggaacttcaaatcattaagagtaattttctctattgtcccaagaaaggtcaagtattagagggcttatcagggggacagaacaatcttttggcctctgtcaattaaaggataccatgtgtggttatttgccactatacatctattgaattgggaattgtagctatgcttccttcctaagattaatatctcaatacttttgcataatagtctggaacacggaattgtacaggtattaggaatgctttcccactctaacctgaattagaaaatgcattggcctaaatttaacttgtctaggtatctttgagatttcacccagaaagaataaaattcagatgaaatgcttcctctttcagtagatgctccctggctattccagcaatgcaaggaacaatttaaataaccataacaatctagcatggtttgcccatttctagaacattaatcacatctcaacttaaagtcattccctatctgacctcctcactaaatctcttggcatatagacttctgcttttaactttgaggcagcacccacatgcaactgtgctttgcacacaataggcactacctatgtttcctatgcataaatttccaagtgttaattcttgagatttctctcacaactctccaaaatgccatttatatcgatataatcagtataggtttgctcatatatttatggtgtgcattttcagatattgttttattaattttacacatcgtatttacttgactattccaaggcaaactgtcttgaatgtcctatctttatttcacaaatggccattattaaactattttttctttatatattgtgatggctggtcccttaaggcagatgtgtcaggagctcatgtgtttaaggaggtctaagattatgaacaatcctcagagggaaaatgggataatggaccaataattgctgctgattgcaaaaatagattttcaccctttcatgagataaaaagaagcgttgtgtaattgctgtaaatgtgtcctatgccttcaggaattggattcagaagatattgcgacgttacacctgggagtctaaatatggttttgtactgattgctgattattatttttaggtatttgcaatctcttgtcttaatgtgctactatatgaatactctgataataccttgaaacaatcccattaactccattaatgtttggccagttttcatgagaggggtcagtatgtttcatgaactcaaaattttattttaaagaaaggttactagtgtggtatgcataggaaaaaaatgagttatcaaacaaatgaatgaggcagaagccatatttgttttaatggactttgtatctattactgtatgaaaccttgacaaaatgatgggagaatccgttaaaagcaaatctggaaaatgagatacttgcacagttggaaatgttgaacaaaagttatttattttatagacagtgacattatcttataggtagcttacaattgaatttttttcaagaaatttaagttgtaatttttacttgaatctttattgttggttctttcctgcaattttggctatatttttttcaatctctgccattagacaaatctatattttcatttcaagatcatttgtgaagtactttgaagcaaaacaaa
